United States Patent 7,550,578 (RICE PROMOTERS FOR REGULATION OF PLANT EXPRESSION) - sequence listing, part 3

SEQ ID NO: 4336 - DNA, 1161 bp, Triticum aestivum
ggacagggacgaagcaatttcatgacccaaaggatgctgcggtgtctgtacacccagcggcggtgggcgcaccgccggggcggcttcgtcaccggcggcactggctggtcgcagaaggccgcccagccgccgtgatgggcgcgaagaagtcggagtggtgggcggtggacggcgagctgcacgagatcggggagggcgtgccacaccgcgagcgcttcgccattccgcgcgacaacctcccgaaccgccgacgcaagcagatgcgcgagcagttcatgcgccgcacgcgtctcgtcctcaaggactcggaacatgaaacctggtgcaaaaaatatatggaactgtaccaagaacttagagagaactgggaacggttgtactgggatgaaggttattcaaaaaagatggccgaagatcgtgctaattatgactctgctgaagaagatgatctagacttctcaccatacagcaggagaaggagctccagtgcagagcccaaacaaggaccttggttttggggaaagcaaacagggtgaaacatgggaaagggttactcaaattcgtgacaagtttgagtatgacagagaaaggagaatgagagagcgagcgtttgctcccatgaatatggagaacaattttggccagcagaactggaaaaggccagaagcccagaacgagtcagggttttcctcggcaaacatagaaactaagtctggtcatgattgggtttcataaatcaaactggtcggggtttccaacgtgaccaagtccctgagatcagcactattcggatttccgaaaggaatcaagtttcagaaatcggcaatatccaaatttccgaaaccagcttgatggaaacaataagtgatttggtgaccagagtcaagttttagccagcatgttgcaatcctgcgggaacactaaaaggtggtgcgcgattgccgagtctttgtgcttgctgatttcacacttttgtaatgctaattgaattgaaaatgagatgagaagtgatgacatgcttttatgttcgttgatgtagtcgtactacagtttagcctcgtctgtcaaaatgagatgagtgtaacataagatacagctgccctattttgccctcgcggccttgcccagctcttatcgtgagacagaatggtttttactcaa

SEQ ID NO: 4337 - DNA, 1184 bp, Triticum aestivum
gaaagctctggtagtgaagaagccatcaaaagactgggcgaagcgcattcagcatgagtgaaaagtcttagagaaagacttgccagataccatattcgtgagggcatacgaggatagaatggaccttcttagagttgtcattatgggtccagcgggcactccttaccatgatgggctctttttcttcgacatttacttccctcctcaatatccaaacatacctccacttgttaactaccgctctggtgggctgcggcttaatccaaacctgtatgcttgtgggaaggtgtgccttagcctgttaaacacctgggctggcagtggatgtgagaaatggaatccatccaattcaaccatgctgcaggtccttgtctccattcaggccctggttttgaatgccaaaccttatttcaatgagcctggatatgctaattcagctaacacacctggcggggagaaaagatccctaacttataatgaagacaccttcctgctgtcctgcaggacgatgttgtattctcttcgaaatccaccaaagcattttgaggatttcgtggccggccatttccgcaagcacgggcgcaacgtcctggtggcctgcaaggcctacctggacggggcgcaggtcgggtgcctcgccgggaacggggtgcaggacgtggacgagggtgacaagagctgctcgctcaagttcaagacctcgctcaagaggctgttcgaggagctgctgatggagttcacggtgaagggagcggactgcagcaagttcctgtcggagaaggcgaagcagtcggccgcctccgccaccacctctagagggcccccggcagacaccaccctgaggctataagcggtggtcgccagccgagccgagccgagccaaaatggtagcaataattttggccatggaagcgattcgattctaggcttgcctagctataactcctcctgccctgacctcgtcggtcgataggaggcgccctacccgagcgagaggggaattaaacctgattgttttttgtgtaagtagtttatgtacatatgccctccccgcctagctcttccggtgaacataatccatccatccgtatgtttagggacaagtatcatcatcagcaccatcatcacctgtgagagagacactatgattaatgtcaccgtcctaggcttaatatatatctgat

SEQ ID NO: 4338 - DNA, 1012 bp, Triticum aestivum
  misc_feature (46)..(46): n = any nucleotide
gtgagattcatcatgtcatgaatccggatccttaccgtggagcttntgggtctgatgctgcagcttatgccaggaagtcgaagaacacataaattttggcagttcaggaagggttggaggttttatcgcagaaactttccaaggtgtaggaggtactattgaactagctcctggatacctgaagtcggtctatgatactgtccggaaggcgggtggtgtctgtatagctgatgaagtccaaagtggttttggccgtactggaagtaactactggggattccagacgcaggatgtcatccctgacattgtaacgatggcaaagggaatcggcaacggtctaccactcggtgcagttgtaacaactcctgagattgctagcgtgatggctcagaagatccagttcaacacatttggtgggaaccctgtctgttctgctggtggattggctgtgctcaaggttctcgacaaggagaaacggcaggcgcattgcgcagatgtcggcgctcacttggtggaacgtctgaaatctcttcagcagaagcatgaaatcattggagatgtcagaggaagggggctgatgcttggggtggagctcgtcactgacaggacggagaagacaccggccaaggctgagaccgctgttctgtttgagaaactcaaggatcttggtgttctagtcggcaaaggcggtctccacggcaacgtcttcaggataaaaccacctatgtgcttctccaaggacgatgcaaatttcttggtggacgccatggactatgcgatgtcagggttctgaggaccctgaacgttcttgtgcctgcccctgaaccgtcaccgggcggctgcgcggagtgcatggggatgccctggtgctggtagcatggtacgtgcccatcgctgggctgcgtcactgcgtgtttgcacacaaggcatgtatatgtatgctgcgtgctcgggtgactatgtttgtgacggtgaaacgcaacccctacccagggatgaataaatggaggaa

SEQ ID NO: 4339 - DNA, 1201 bp, Triticum aestivum
ccagtcctgcgtccgctcctcccgttccccgccctctaccgcaccctcctcaccgacaacaatgccgccggcgccggccgccaccggcggcaacggagcttcattcgagatcctggacagcgagcccacgctgcacgcccgctactacgcgcgcggcgacaacgtgatgctcccggaggtgcccttcgaccgcttccgcgtcggctcccagttcttcgtgctcgccaggcggcacgccgtcatggtggtccgggaccggcggctctggaacaagttcaaggcgccgtgcctcgtcaaggagaaggactcgtgctacccggaggagcactacttcccgacgctgctcgacatgcaggaccccgacggctgcaccaagtacaccctcaccagggtcaactggaccgacgccgtcggcggccacccgcacacctaccagccggaggaggtctccggggacctcatcagggagctcaggaagtccaacggcacctactcccacatgttcgcgcgcaagttcgcgcccgagacccttgcgccgctcatggagatcgccgactccgtcatcctccgtgactaggcgcgaagtgttcgtggagatgaacagaacaagggttggtgatgtgatgaagaagcacaagctgatccatccatcccctttgtggtttcttcggagaggagcaagcaaccagcaccaaacccacttcgccttgttgttccgtcgctggccgtcggcgaaggggatgctgctgcttgcccaggctcagagagtgatgtggtgttggtggcgaagtgccccggctgcctctatcctatgtgagtatttgttgttgtgtttcttggtgtttttcctttccacttcgctccgagcaagaggaagtcgtcggcacgcacgcggtaggcgcgctgctggtagttagcacgaactatcatcctatgtattcacaacggaggcaacctgtcgatacatgtagcgatggtttttgtagtgtatgttatccccaccatgttgtcattgtcaatatcacacaccttttcctctaaaaaagaacaacaaaacagaggggggcgccaaaggagcccgctaagacgcggggggcaagcaagccctcatgtggccaaataaaccgggcggtttaccgggcgtggaaacgcgggtccacttagctgaaccctcttcaaagacgccaacaagagcctagcg

SEQ ID NO: 4340 - DNA, 1206 bp, Triticum aestivum
  misc_feature (370)..(395): n = any nucleotide
ctacagcggccacggcacgcgcctgccggccgagaccggccaggacgacgacaccggcttcgacgagtgcatcgtcccctccgacatgaacctcatcacagaccaagatttcacagagctcgtgcagaaagtcccagatggctgcctgttcaccatagtctctgactcttgccacagcggtggcctgcttgacaaggccaaggagcagattggccacagcacaaagcagaacaaggcgcagcaaggcaaacgggaagagcggtctgattccggctcgggcggcttccggacgttcctcaaacagaccgtccgggacgcgttcgagtcccaaggagtccacctccctcgccgcggcggccagcagagcagnnnnnnnnnnnnnnnnnnnnnnnnnnaggcgccgagcctggactcaggcacagacgggcacgtgaagaaccggtcgctgcccctctcgacattcatcgagatgctcaaggagaagacggggaaggaggacatcgaggtggggtcgatccggatgacgctgttcaacgtcttcggcgaggacgcgagccccaagatcaagaagttcatgaaggtgatgctggagaagctgcagcaggggcagcacggcggcgtggtgggcctggtgggcgcgctggcacaggagctgctgagggccaagctgcagggcaagcaggaggagctgaagccggccatggagcaggaggtgcacggcgtggaggaggtgtacgccgggacggcggcgagggcgccccacaacggcgtcctcatcagcgggtgccagaccgaccagacctcggcggacgcgacgaccgccaagggcctgtcctacggcgcgctcagcaacgccatccaggccatcctcgcggagaaggacggcaaggtgagcaacaaggagctggtgctgagggcgcgcgggctgctgtccaagcaggggtacaagcagcagcctgggctctactgcagcgacaggcacaccgaggtggctttcatatgctgagagcgtgaaacatcatccgttgtctttgtccgtcgatgagagagaacgttttctcctcgtgtgtcaaaactgtctgctattgtctgtggactgtggttttggagacccggacgccatgtgttgctaagattggactgtttgatgtttcatctcagaataacaatcacatgctctcaggtaattatatacctataatatat

SEQ ID NO: 4341 - DNA, 773 bp, Triticum aestivum
accggtcggtgccctctcgacgttcatcgagatgctcaaggagaagacggggaaggacgacatcgaggtggggtcgatccggatgacgctgttcaacgtcttcggcgaggacgcgagccccaagatcaagaagttcatgaaggtgatgctggagaagctccagcaggggcagcacggcggggtggtgggcctcgtgggcgccctggcgcaggagctgatcagggccaagctgcagggcaagcaggaggagttgaagccggccatggagcaggaggtgcacggcgtggaggaggtgtacgccgggacgacggcgagggcgccccacaacggcgtcctcatcagcggatgccagaccgaccagacctcggcggacgccacgacggccaagggcctgtcctacggcgcgctcagcaacgccatccagtccatcctcgcggacaaggacggcaaggtgagcaacaaggagctggtgctgagggcgcgccagctgctgtccaagcaggggtacaagcagcagcctgggctctactgcagcgacaggcacaccgaggtggccttcatatgctgagagcgccgtgaaacatcatcatccgttgtctttctttgtccgtcgatgggatgggagaagaaacgttttctcctcgtgtgtcaaaactgtctgttgtggactgtggttttggagacctggacaccatgtgttgctaagattggactgtttcatcacagaataacaatcacatgctctgaggttatataataatactatatacata

SEQ ID NO: 4342 - DNA, 736 bp, Triticum aestivum
cgacatcatcgaaagctcaggagaagacgggaaggacgacatcgagtcgggtcgatccggatgacgctgttcaacgtcttcggcgacgacgccagccccaagatcaagaagttcatgaaggtgatgctggagaagctccagcaggggcagcacggcggggtggtgggcttcgtgggcgccctggcgcaggagctgctcaaggccaagctgcagggcaagcaggaggagctgaagccggccatggagcaggaggtgcacggcgtggaggaggtgtacgccgggacgacggcgagggcgccccacaacggcgtcctcgtcagcgggtgccagaccgaccagacctcggcggacgcgacgacggccaagggcctgtcctacggcgcgctcagcaacgccatccagtccatcctcgcggagaaagacggcaaggtgagcaacagggagctggtgctgagggcgcgcgcgctgctgtccaagcaggggtacaagcagcagcctgggctctactgcagcgataggcacaccgaggtggctttcatatgctgagagcgccgtgaaacatcatccgttgtctttgtccgtcgatgggaggaaaaacgttttctccccgtgtgtcaactgcctgctattgtctgtggactgtggttttggagacctggacgccatgtgttgctaagattggactggtcgatgtttcatcacagaataacaatcacatgctctgaggttataatat

SEQ ID NO: 4343 - DNA, 711 bp, Triticum aestivum
  misc_feature (420)..(463): n = any nucleotide
tctcgtcgggcgggtcccacagcatccacaccgtccggcgccgtcgtcgccgtggacggaccaggccctgaccttgctgatcaacctggcgctgagctggcccgggaagaaggagatcgcggcgaaccaggccatcgtgggcgacatcgtgttcatcctggacaacggcgaggcggcggagcaggagaaggcggtgtcgtgcctgtggatgatctgcaacggcgacgaggggtgcagccagacggtgctgcaggagggcgtgatcccggcgctggtgtccctaacggcgaacggcacgggcaaggccaaggacaaggcgcagaggctgctccggctgttccgggagcagcggcagcgcgagctggagcagcagcagccacgggtggagctgctcgaggtggccagccaggccgccgcgcnnnnnnnnnnnnnnnnnnnnnnnnnnnnnnnnnnnnnnnnnnnngaggccgcggggaagacggcgtccgagcagggcagcgagggcaagaagccgccggcgcggctgagcaggtccaagtccaagcggctggccagggtcatcacctgcctcatcaagaagtggacgacgccaggcggcggcggcgacaagtgtaaactgtaaccctgtagaatgtgtggtggtactgtatcgtcacattcaccaaaaatgtgtgtgctctccatgtgtaaaatacaactagcgaaattgta

SEQ ID NO: 4344 - DNA, 793 bp, Triticum aestivum
tctcgtcggcgtggtccacagcatccacaccgtcctggcgccgtcgttgccgtggacggaccaggccctgaccttgctgatcaacctggcgctgagctggcccgggaagaaggagatcgcggcgaaccaggccatcgtgggcgacatcgtgttcatcctggacaacggcgaggcggcggagcaggagaaggcggtgtcgtgcctgtggatgatctgcaacggcgacgaggggtgcagccagacggtgctgcaggagggcgtgatcccggcgctggtgtcgctgacggcgaacggcacgggcaaggccaaggacaaggcgcagaggctgctccggctgttccgggagcagcggcagcgcgagctggagcagcagcagccgcgggtggagctgctcgaggtggccagccaggccgccgcgctagctaggtaactaggtaggaggaggtagctagctagctagcaagcagctaactagctaggtaggtatgccgctgcggggaagacggcggcgtccgagcagagcggcgagggcaagaagccgccggcgcggctgagcaggtccaagtccaagcggctggccagggccatcacctgcctcatcaagaagtggacgacgccaggcggcggcggcggcgaacaagtgtaaactgtaaccctgtagaatgtgtggtggtactgtaccgtcacattcaccaaaaatgtgtgcgctcgtgaagctccatgtgtaaaatacaactagcgaaatcgttcacgacgttgtaactgcgactgggagaagattacagccgtcgtc

SEQ ID NO: 4345 - DNA, 1275 bp, Triticum aestivum
  misc_feature (916)..(940): n = any nucleotide
tgaggtggtcgagcaggtcaggttccagttgaagggtgatgatgagctcagggactatgtgggtgctaatggtattactgagccactcacctgcttcctgaagatggctctcagcagagaagacgtgcaatctcaggaggtcggaacaatggctcttttcaatcttgccgtcagcaataacaggaacaagcggcagctgctctcagctggagttatccctctgatggagcagatgatgcagaaaccggagacctgcgaggctgcggtggcgatgtacctcaacctctcctgtctggaggaggcgcaggccatcatcggctcgagccaagtcatccctgtcctgatcaggtgcctgcaagaagaagggtaccggagcgacacgtgccggctggacgcgctcctgacgctgtacaacctgtccctgcacgcgcccaacatcccggcgctcctctcgtcgggcgtcgtccacagcatccacaccgtcctggcgccatcgtcgtcgtcgtggacggaccaggccctgaccttgctgatcaacctggcgctgacctgggccgggaagaaggagattgcggcgaaccaggccatcgtgggcgacatcgtgttcatcctggacaacggcgaggcggcggagcaggagaaggcggtgtcgtgcctgtggatgatctgcaacggcgacgaggggtgcagccagacggtgctgcaggagggcgtgatcccggcgctggtgtccctgacggcgaacggcacgggcaaggccaaggacaaggcgcagaagctgctccggctgttccgggagcagcggcagcgcgagctggagcagcagcagccgcgggtggagctgctcgaggtggccagccaggccgccgcgcagcaggaacaggaggaggaagagcagcagcagcaacaacagcannnnnnnnnnnnnnnnnnnnnnnnnaagtacggcggcgtccgagcagagcagcgagggcaagaagccgccggcgcggctgagcaggtccaagtccaagcggctggccagggtcatcacctgcctcatcaaaaagtggacgacgccaggcggcggcggcgacaagtgtaaactgtgaccctgtagaatgtgtggtggtactgtatcgtcacattcaccaaaaatgtgtgtgctcgactgctcgtgaagctccatgtgtaaaatacaactagcgaaatcgtacagacgttcaactgcgactgggagaagagaagagcttcttctcccgtccgagtaaaactgtaattagttctcgtgctagt

SEQ ID NO: 4346 - DNA, 1277 bp, Triticum aestivum
ctcaggggtgtcctcccccgcggcctaacgggtccaaagggggcgccccaggggaaaagaagggcgggggagccacgaggtaacaacgggacctggcaaaagaattttgtcgcccgccactataggagttcccacttccctctagaaaaacatattcagtgttttgatattagcttgcttgtgaagcccttggctacaagtggaaagatagccgcaaagtcttcaaaatcgaaatgatgacataattcattggaatcatacccttaagtttctgaagcctattttaacacaagagcaagagcaagaattctacccacacactgaggaacggcaatctcaggcaaagcactctcgggaagagcaacctcaaatggggcagtctcagggaaagcaacctcaaacgggttgtcaggcaaagcacactctgggagagcaacctcaaacgaggcagtctcaggtaaagcactctcagggagaccagcctgaagaaggggagggagggcgatctcaagaagaacaatcgcaggcaaggccatatctgggatgtcaacctcatccatcgcagtcaacttatggtggttggaatggtttggaggagaacttttgtgatcataagctaagtgtgaacatcgacgatcccagtcgtgctgacatatacaacccgcgtgccggtacgataacacatctcaacagccaaacgttccccatccttaacatcgtgcaaatgagtgctacaagagtacatctctaccagaatgccattatttcaccattatggaacattaatgctcatagtgtgatgtacatggtccaaggacatatatgggttcaggttgtcaatgaccatggtcgaaatgtgttcaatggccttctgagcccagggcaactattaatcataccacaaaactatgtcgttctgaagaaggcacaacgtgatggaagcaagtacattgaattcaagactaatgcaaattccatggttagtcacatcgcgggaaagaactcaatcctcggcgccttgcccgttgatgtcatcgccaatgcatacggcatctctaggacagaagctcgaagcctcaaatttagtagggaagaggagctgggggtattcgctcccaaattcagtcaaagtatcttccatagttttcctaagggcggagaagattcatcttcagagggcatgacctaatgtcagaactacctcatggagtaaaataaagacatcactgagcgtgtagaactttgatgtttccatatatggtcatctcaataagata

SEQ ID NO: 4347 - DNA, 868 bp, Triticum aestivum
ggcagtctcaggcaaaacactatcaaggagaccaacctgaagaagggcaggaagggcaatctcaagaagaacaatctcaggcagggccatatccgggatgtcaacctcgtgcagggcaatctcatgcatcacaatcaacttatggtggttggaatggtttggaggagaacttttgtgatcataagctaagtgtgaacatcgacgatcccagtcgtgctgacatatacaacccgcgtgccggtacaataacccgtctcaacacccaaacgttccccatccttaacatcgtgcaaatgagtgctacaagagtacatctctatcagaatgccattatttcaccattatggaacattaatgctcatagtgtgatgtacatgatccaaggacatatctgggttcaggttgtcaatgaccatggtcgaaatgtgtacaatggccttcttagcccggggcaactattaatcataccacagaactatgttgttatgaagaaggcacaacgtgatggaagcaagtacattgaattcaagactaatgcaaactccatggttagtcacatcgcgggaaagagctcaatcctcggcgccttgcccgttgatgtcatcgccaatgcatacggcatctctaggacagaagctcgaagcctcaaatttagcagggaataggagctgggagtattcgctcctaaattcagtcaaagtatcttccatagttctcctaccaacgaagaagagtcatcttaagagcgcatgagctaatgtcaaaactagctcatggactaaaataaacacatcattgagtgtgtagcactttgatgtttccatatatggtcgtctcaataagatatcaacaaaggtccattgtgttt

SEQ ID NO: 4348 - DNA, 1313 bp, Triticum aestivum
gccaattgtggctatctatgttttcgacgtaaacaactatgctaatcaacttgagcctaggcataaggaatttttgttcgctggcaactataggagttcgcaacttcactctagtcaaaacatattcagtggtttcgatgttcgattgcttgctgaggccttgggtacaagtggaaaaatagcgcaaaggcttcaaagtcaaaatgatgacataattcatgtgaatcatacccttaaatttctgaagcctgtttttacacaacagcgatagccagaatcctacccacacactcaatatgaggaagggcaatctcaggcaaaacactctcaggaagagcaacctcaaatggggcagtcacaggaagagcaacctcaaatggggcagtcacagggagagcagcctcaaatggggcagtctcaggcaaagcacactcagggagagcaacctcaaatggggtggtctcaggcaaagcactctcagggagaccagcctgaagaagggcagggagggcaatctcaagaagaacaatctcaggcagggccatatccgggatgtcaacctcatgcagggcaatctcatgcatcacaatcaacttatggtggttggaatggtttagaggagaacttttgtgatcataagctaagtgtgaacatcgacgatcccagtcgtgctgacatatacaacccgcgtgccggtacgataacccgtctcaactcccaaacgttccccatccttaacatcgtgcaaatgagtgctacaagagtacatctctaccagaacgccattatttcaccattatggaacattaatgcccatagtgtgatgtacatgatccaaggacatatctgggttcaggttgtcaatgaccatggtcgaaatgtgttcaatgaccttcttagcccggggcaactattaatcataccacagaactatgttgttctgaagaaggcacaacgtgatggaagcaagtacattgaattcaagactaatgcgaactccatggttagtcacatcgcaggaaagaactcaattctcggcgccttgcccgttgatgtcatcgccaatgcatacggcatctctaggacagaagctcgaagcctcaaatttagcagggaagaggagttgggagtattcgctcctaaattcagtcaaagtatcttccgtagttttcctaacggcgaagaagagtcgtcttaagagcgcatgagataatgtcaaaactagctcatggactaaaataaacacatcattgagtgtgtagcactttgatgtttccatatatggtcgtctcaataagatatcaacaaagtcc

SEQ ID NO: 4349 - DNA, 1471 bp, Triticum aestivum
  misc_feature (1200)..(1200): n = any nucleotide
caagaaattgcagttcagattggtggtatgatgatgtgtcatgcttaagccttccattatacaagaaggtaatctcagctatggaataccgaggcgtcaatcaggacattattgttggatcccttaaccattatgccaaaaggcgtttacctggtctgaatcggcgcaaaagcattagcgatgtcagtaactgcctttcagtgtcaactttaaccgccatgccttctgaagaggagcaaaggtatcttcttgaggagattgataggctgttacctttccaaaggggtgttacatcttgcaagctgttatttggccttctgcgcacagcgatcttccttaaagccagctcatcctgcatgtccaacttggagcgtcggataggtttgcagcttgataaggccactctggaagatcttctaataacaaacatgtctgaatctattgaaatgctctatgatgtggattgcgtacataggattcttgaccatttcttggcaatggatcaagaaactggtggagcttctcctggcattggcgaggatgggcacctattggcttctccatctctattgccgattactatggttgctaagttgatcgacggctacctagctgaagttgcaccagatgccaacctaaagttgccaaagtttcggtctttggctgctgccataccagactatgctcggccaatagatgatggactttatcgcgctgttgacatctatctgaaggctcatcctcatctgtcggaatcggagaaggaggagctttgccgggtgatggactgccagaagctctccctggaggcttgcacccacgcggcgcagaacgagcgtctccccctgcgggtcatcgtgcaggtcctcttcttcgagcagctgcagctccggagctccatcgccgagtgcctcatgatctccgagaacctcgagggcggatcgaggcagctcggcatgccaacctctagtgagcaacaccgtggcggcggcggctggcccctggccgccagggagaacaggccctgcgcgagggcatggacggcatgaagctagcgggtggccgagctggagaaggagtgctccaccatgcgggaggagatcgcgaggctgggccgcagcaggagcaccggcaagtagcaggctgttctcccttggcgcgaagccgcagatctgcagcaccgccaaggtatgctgcccntgcgaaggcggcaacgtcgagcgacgacgacaagctggccgtggtgaaagctgatgccacaccccggctgaagctgagcagacacaagaagaacctgtccatagaggcctagctccatcgtttgtgctactctgtactctgagttgctgttttgccggtgaacttgttagatgctttttacataccaccaccacctgtgaacgaagaactggaagaagaaaatgagattgtatgagacctcattctaagttttttacagtcaacgcggtat

SEQ ID NO: 4350 - DNA, 654 bp, Triticum aestivum
tagccatcgcaatgctctggaatggcagcgaacgtccctcctatggggtgtggcgcgagcacaccaagaaattctccccccagtggttcgcagcagtccatgctgccgttccgttcattgcgatgctgaggaagtccgtcaacatgcccaggaccgcgatggtgttcaccatagcagcctccatcctcgggcagaccatcgggtctagggccgagcgcatccgcctgaagactctggctgcaaagggcactgccggccccgccaccgcagtcactgtcatgtatccagacaagggcggcagctgcagcgatgccgagggcaaggcgtgggatcctcttgcactgaagatgcctggctctgctaacgccggcgctcctgcaccaacccctagcatgtgcttctaaccgcggaatttagcggccaggtaccgatttctatttatcgtgtatgtaattgccttgcctgttcccagaaagcagagctgtttgtgatattttctgaggatgaggcaagtggaataaggtgctatattaccatgtcctgctgtgaacctgtcattgtgtgtcgtcagtccatgcatctgtaatctgatgctgatatatatgatatatgtacccagaaacaattatattgtggttgtccttaaagcgattt

SEQ ID NO: 4351 - DNA, 1495 bp, Triticum aestivum
ccgcgctgtgcccaccacacgagtcctctccctgtgtgtcccccaccgcacggacggagacaagcacgcaggcgagcagctctccggcgagtcgtctaggatggaagtgctgttcagtagcctgttctgtgactcagcatcatcggagaacttttctggtcatcctggtgttgagagatgcccattcctgaggaacatcaatggagctacaaccttttcattttcttctgctttgcctgtagctgcccgaggaggcaagggtcccatctttgaggatggaccaggatttgagtcggcattcaagcttttccatggacaggatgggatagttcccctttcaggaagatcatatgtgcctgatgagaaccgcagtgagagcactgatgtcaagcccgaacctgctcttccctttaatccattggctgctagagccgctaccataagtctatcagcatttggaccattcgggttcaacttctttaatggcaagggcaaaaagcagaacaagaagcccaacaatctcgaccagtcacagaagaagcctaacaagccagatcagaattccatgaaacaaaaaggaggcaacccaccgtcccatgaggcaatgagtgatgaatggctagaaaatggacagtgcccactcgctcggtcttaccgggcaatgagtggtgttctgccccttgtcgccaaggcactacagccaccagctggtatgaagctgaagtgcccgcctgcaattgttgctgcacgagcggcccttgcacgcacaacccttgtgaagtccctccgtccccagcccctgcctgcaaagatggtagccattgctatgctcgggatggcagcgaacgtccctctaggtgtgtggcgcgagcacaccaagaaattctccccccagtggtttgcagcagtccatgccgccgttccgttcatcgcgatgctgaggaagtccgtcaacatgcccaggaccgcaatggtgttcaccatagcagcctccatcctcgggcagaccatcgggtcgagggccgagcgcatccgcctgaagactctggctgcaaagggcaccgccggccccgccaccgcagtcaccgtcatgtatccagacaagagcggcagctgcagcgacgccgagggcaaggcgtgggatcctcttgcgctgaagatgcctggctctgctaacgccggcgctcctgctccaacccctagcatgtgcttctaaccgcggaatttagcggccaggtaccgatttctatttatcgtgtatgtaattgccttgcctgttcctggaaagcagagctgtttgcgatgttttctgaggatgaggcaagtggaataaggtgctatagtaccatgtcctgttgtgaacctgtcatggtgtaacgtcagtccatgcatctgtcatctgatgctgatatatatctaccaagaaacaaaacaattatattgtggttgtccttgaagcaatttgttatgctgtgcctgaaactttggttgttac

SEQ ID NO: 4352 - DNA, 862 bp, Triticum aestivum
  misc_feature (838)..(838): n = any nucleotide
gaatgtcatccacttactgcatttcatttaaagtgaagaatactgaggctgtccctcctgtgaaggatcttagaaagacaatgagaattcaagcattgcgctgtcatgtattgtacagccatgatggcagcaagttgaacttcatacctgttctggcatcacgatcccaagcactaaggtacttgtatataaggtggggggtagagctgtcgaacatgacggtggttgttggtgaaagcggcgatacagattatgaagggctacttggaggcatgcagaagaccatcatactcaaaggctcatttaattccgcgccaaaccagcttcatgccgccagaagctattcgctagaggatgtcgtatcgttcgacaagccaggaattgcttccgtcgagggctatgccccagataacctgaaatcagctctacaacaatttggtgtcctggagggctaggatcaccaacttgtcacagtcagcagaggaataaagaggtgtgttgatacacactcctcgctatggggtcgcacacgagacacggcgacctcttcccgtgttgccagacgctaccgtggcggcaatcgagcacaagggcgtggcttgcatgctcggtttaccccttcagattttgcgacctacattcaattttcaactcatggtgaaattgttcataggttccaaataaataactagtgtcgaactatggtcataaagtgcgtgctatagggaaggggaatgagtaccctgttgcgtggaaaccatatcttcatgcatcttaactgattagctccttcacttgtgcactccgctctgatgatcagacgcgcggtactaagagnactttggaactgtttatggacact

SEQ ID NO: 4353 - DNA, 860 bp, Triticum aestivum
taaagtgaagaatactgaagctgtccctcctgtgaaggatcttaggaagacaatgagaattcaaagcattgcgctgtcatgtattgtacagccatgatggcagcaagttgaacttcatacctgttctagcatcacgatcccaagcactaaggtacttgtatataaggtggggcgtagagctgtcgaacatgacggtggttgttggtgaaagcggcgatacagattatgaagggctactcggaggcgtgcagaagaccatcatactcaaaggctcatttaattccgcgccaaaccagcttcatgccgccagaaactattcgctagaggatgtcgtatcgtttgacaagccaggaattgcttccgtcgacggttatgccccagatatcctaaaatcagctctacaacaatttggtgccctgcagggctagaatcaccagctttgtcagagtcagcagaggaataaagtaggtgtgtggaggcacacttttgctatggggtcgcacacgagacacggcggcctcttcccgtgcctggtatctggcaagggtgtgactgtggcggcaattgagcacaagggtgtggcttgcatgctcggtttaccccttcagattttgtgacctgcattccattttcaacgcatggtgaaattgttcataggttccaaataaaaacagttagtatcgaactatggtcataaagcgtgtgctatagggaatgaagtaccctgttgtttggaaaccatatatatacccaacaatgtgcatgcatctctacgaataattagcatctccaaggagctggagctggagcgagcaatcttaattttagtggattgtgtaaaaacactttcctcaccagtt

SEQ ID NO: 4354 - DNA, 1621 bp, Triticum aestivum
ctgaagtttctgaaacagatcacctggtgactctttgagggatattcatgatatatcacttaacttgaagatctccttggacagtgaaaaatcaggcagcatgtcaaaatatggaaggagttcaaccagtgataggagaaaccttgaggatgctgtacaaaaattttcagaagctgttagtgctggcacaaaggatgagtctggtgagaaagctggggccaccacaggctccaataaatggccatctctgcgaaggagaaaacacatcgttgttattgctgtagattctgtgcaagatgtggacttggttcagattatcaaaaacatttttcaggcttcaaacaaagaaaaatcatctggtgctcttggttttgtattgtcaacatctcgagcagcatcagagatacatcctttgttaacatctgggggcatagaaattactgattttgatgccttcatatgcagcagtggcagtgatctttgctatccatcttcaaattcagaagacatgcttagccctgccgagcttccatttatgattgatcttgattatcactctcagattcaatatcgttggggaggagaaggtttaaggaagacactaattcgttgggcagcagaaaagaacagcgagagtggacaggaagcagttgttgaagatgacgaatgttcatccacttactgcatttcatttaaagtgaagaatactgaggctgtccctcctgtgaaggatcttaggaagacaatgagaattcaagcattgcgctgtcatgtattgtacagccatgatggcagcaagttgaacttcatacctgttctggcatcacgatcccaagcactaaggtacttgtatataaggtggggggtagagctgtcgaacatgacggtggttgttggtgaaagcggcgatacagattatgaagggctactcggaggcgtgcagaagaccatcatactcaaaggctcatttaattccgtgccaaaccagcttcacgccgccagaagctactcgctagaggatgtcgtatcgttcgacaagccaggaattgcttccgtcgacggttatgccccagatatcctgaaatcagctctacaacaatttggtgccctgcagggctagaatcaccaacctgtcacagttagtaaaggaataaagtaggtgtgttggtacacacttttgctatggggtcgcacacgagacacggcggcctcttcccgtgcctggtatctggcaagggcgcgaccgtggcggcaatcgagcacaagggtgtggcttgcatgctcggtttaccttaccccgtcagattttgcgacctacattccattttcaaacgcatggtgaaattgttcataggttccaaataaatacagttagtatcgaactatggtcataaagcgcgtgctgtagggaatgaagtaccctgttgtttggaaaccatatatatacccaacaatgtgcatgcatctctacaaatacataggagcgggggaagtgcaactccgccgtcttaattttaccgggttatgtacaatttccccacgggttatttatgttttctttcttcatgcatcttaactggttagctccttcacttgtccactccactcagttgtaaaaaca

SEQ ID NO: 4355 - DNA, 576 bp, Triticum aestivum
tcaccgatccccaacttcaacgggctccatgtcctcctggtggacggtgatgacaccaaccgagcggtcacccacaagctcctggagaagctcgggtgccgagtcttttcggtcagctcgggcatccagtgcatgagctcctttgcgggcggcgagtcgtccttccagctggtgcttctggacctgacgatgcacacgatggacgggttcgaggtggccctggcgatccgcaagttcaggagcaacagctggccgccgctgatcgtggccctcgcggcgagctcggacgacaacgtccgggaccggtgccagcggtcggggataaacggtctgctccagaagcccgtcacgttggcggccctgggggatgaagtgtatagagtccttcagcacaactgaaagttgtcgtcgtctctgtggatcttgatagattgttgtagcttgatgggtagttgattcgccactgccactagctagtagttcccttttgatcgattgttatgccaggttaggtcccatacagatgacaagaaacatttgtgcacaaacaaaaaggaaggaatttcttaattgtac

SEQ ID NO: 4356 - DNA, 1621 bp, Triticum aestivum
caatcctgaggcagggctccggtcgctgtgatacggatgccgatgctaagggtgtccaatttcaaaggaggcaccccggaaatgatggaaacgagctatgctattctggtcttggtcttacccgaggacggttccctagggtggggtgagcaggagctggagattgtcgaagtgatcgccgatcaagtggcggtcgcgctctcgcatgctgctgttcttgaggagtcgcagctgatgcgagagaagcttgctcagcagcacagggacttgctgcaggcaaagcatgaggctgtgatggcaactgaagccaggaattcctttcagagtgccatgtatgacgggatgcgcagaccgatgcactcggtccttggtctcgtctcgatgatgcaacaggaaagcatgaatccagagcaaaggctcgtgatggacgccatcgtcaagacaaccagtgttgcctcaacgttgatgaatgatgtcatgcaaacatcgacgatggaccgtgagcacttatctctggtgaggaggccattcagcctccactccttgattaaggaagcagtcagcgttgtaaggtgtctgtgtggctccaagggggttgatttcgagtttcaagtggagaattctttgcccgaaagggtcgttggcgacgagaagagggttttccatattgtcttgcacatggtaggcactctgatacaccagtgccgtgcgggctgcctctctttgtatgtgaatagttacaacgagatggatgagaggcataataatcaggactggatgctgctgcgaagagcaaacttttctgccggatatgtgtgtgtcaagtttgagattaggattaaaaaatccagaaacagccttttgggtgcgtctgccagccaaataagtcaagagccgaacgctagcagttcggagatgggccttagcttcaacatgtgcaagaagattgtgcagatgatgaatggtaatatctggtccgtatcagacccagaagggttgagagagacggtcatgctggctctccagttccaggtgcaacatgtgacccctgtctcaggagcatcctcggacctataccgattatcaccgatccccaacttcaacgggctccatgtcctcctggtggacggtgatgacaccaaccgagcggtcacccacaagctcctggagaagctcgggtgccgagtcttttcggtcagctcgggcatccagtgcatgacctcctttgcaggcggcgagtcgtccttccagctggtgcttctggacctgacgatgcacacgatggacgggttcgaggtggccctcgcgatccgcaagttcaggagcaacagctggccgccgctgatcgtggccctcgcggcgagctcggatgacaacgtccgggaccggtgccagcggtcggggataaacggtctgctccagaagcccgtcacgttggcggccctgggggatgaactgtatagagtccttcagcacaactgatctctgtggatcttgatagattgttgtagcttgatgggtagttgattcccttttgatcgattatgccaggttaggtcccatacagatgacaagaagcatttgtgcaaaaactaaaaaaaaagtaaggaattaattgtac

SEQ ID NO: 4357 - DNA, 726 bp, Triticum aestivum
ccgaagtgtgttcctgaggaccagatcgagaaaccggtgcaccgtatgccgacgcttttccggcgcccatctgcaggacgcgggaactacgcaacggcatgggggtagtagtttgctgtaatcacatgcgaaggcaagatgagataactcaggtcataattcatgagttagtacatgcttatgatgactgtgttgtcaagaacatcgactggaaaaactgcgctgaccacgcttgctctgagattcgagctaatcatcttagtggcgattgccattacaaacgtgaactgatgaaaggcttcctgaagataaaggggcatgagccagaatgtgtcaaaagacgtgcgctgctttctgtcaaggtgaacccgcactgttcagaaaaagatgcagaagctgcagttgagaaggtgtgggatatgtgctacaacgacccacgcccgtttgataaggctctatgaagtgaaagctggtagggcagttttgttaactctcagacgggttctatcaagtgtatcctgtgggacagtctagtttcccttcagacgggctccatgtaagtacttcagcaaagcgttgcaacaaaatctggaaatttggtgctggggcaaaactttgaatgtcatgatattagtccagacaatctaacagattattccatgtaatccaattgttttacatggcatatagtgaaagttctctgagctctaaataagagtgggtgtg

SEQ ID NO: 4358 - DNA, 736 bp, Triticum aestivum
ctgaggagcagatcgagaaccgggcaccgtatgcccgacgctttcccgccggccatctgcacgtccagcgggactacgcaagcggcgtgggggtacaagtttgctgtaatcacatgcgaaggcaagatgagataaatcaggtcataattcatgagttagtacatgcttatgatgactgtgttgtcaagaacatcgactggaaaaactgcgctcaccaggcttgctctgagattcgagctaatcatcttagtggcaattgccattacaaacgtgaactgatgaaaggcttcctgaagataaaggggcatgagccagaatgtgtcaaaagacgtgcgctgctttctgtcaagaacaacccgcactgttcagaaaaggctgcagaagctgcagttgagaaggtgtgggatatgtgctacaacgacccacgcccgtttgataaggctctatgaagtgaaagctgccagggcagttttgttaactttcagccgggttctatcaagtgtatcctgtgggacagtctagtctctcttcagacgggctccatgaagtacttagcaagcgttgcaacaaaatctggaaatttggtgctggagcaaaactttgaatgccatgacattagtccagacaatctaacagattattccatgtaatgcaattgttttacatggcatatagtgacagctgactgagctataaataagagtggctgtgaatgattaattctttataccagcta

SEQ ID NO: 4359 - DNA, 689 bp, Triticum aestivum
gtccagcgggaatacgcaagcggcgtcgggggtacaagtttgctgtaatcacatgcgaaggcaagatgagataactcaggtcataattcatgagttagtacatgtttatgatgactgtgttgtcaagaacatcgactggaaaaactgcgctcaccaggcttgctctgagattcgagctaatcatcttagtggcaattgccattacaaacgtgaactgatgaaaggcttcctgaagataaaggggcatgagcccagaatgtgtcaaaagacgtgcactgctttctgtcaagaacaacccgcactgttcagaaaaagctgcagaagctgcagttgagaaggtgtgggatatgtgctacaacgacccacgcccgtttgataaggctctatgaagtgaaagctgccagggcagttttgttaactttcagacgggttctatgaagtgtatcctgtgggacagtctagtttctcttcagacgggctccatgaagtacagtacttagcaaagcgttgcaacaaaatctggaaatttggtgctggagcaaaactttgaatgccatgatattagtccagacaatctaacagattattccatgtaattcaattgttttacatggcatatagggacagctgactgagctctaaataagagtggctgtgaatgattaattctttataccagctaagtattg

SEQ ID NO: 4360 - DNA, 548 bp, Triticum aestivum
  misc_feature (174)..(193): n = any nucleotide
gaagcacaaaagcttagcggcggtggttattgtgcatttgtagatgcagagcatgctttggatccaactctggcagagtcaattggtgtcgacaccggtaacttgcttctctctcagccagactctgctgagcaagcactcagtcttgtagacacgctgattcgaagtggctcnnnnnnnnnnnnnnnnnnnnacagtgtagcagctcttgtccccaagaccgagcttgatggagagatgggtgatgcacatgtggctctccaagccagactgatgagtcaagctcttcgcaaactgagccattctctttcactatcccagacagttttgctatttattaatcagatcaggtctaaggtacagacgtttgggggaggatttggagggccacaagaggtcacttccggtggaaatgcccttaaattttatgcctcagttcgcctgaacatcaggcgaattggcatggtaaagaaaggtgaagagattataggaagtcaggttactgtgaagattgtgaaaaacaagcatgccccaccgttccaggactg

SEQ ID NO: 4361 - DNA, 705 bp, Triticum aestivum
ggcacgcacccgcgagaccagtctcccggcgtccattgccatcatgtcatcgcaggctggtcaggttggtgtttatgggtatactgcttactccgcgagcaagttcgcactaactggacttgcagagtcgctgcagcatgaggtcgtttcggacgatattcacgtgtcgctgatcttccctcctgacacagagacaccgggtcttgtcgaggagaagaaaaagaggccagagcttaccactatcatagcagattcatctggtggaatgaaggctgatgatgttgctatgaaggctctaaccggcatcaaatctgggaggtttattatcccctgcaatttcgagggagcaatgttagctatagccacttctggtctaaccccccagagttccccgttaattgcattcgtggaggtgatcggtgctggactgatgcgatttgtagcactatgtttccagtggaattggttctctactattgagaactggtgcgccaagaacaagaaacatgggtgaaagcccaacctgggattcccagattttcaagggcttacaatttatatacaaccaataatgtaccttgttatccctggactgaatgtatatcccacttgtactttgggatacaatgtatatctgggttattgtttttgaccagttatacttagcacgttgtacacttgtactggacagacagttcaaaattc

SEQ ID NO: 4362 - DNA, 561 bp, Triticum aestivum
taaaagagcaagcggcgtcaagtaccttgacaagaaatggtgtgtgctgaagcccactgtcagcctcgacgacccaaagcttccagacacggtgagctacgcgtgcgccagggcagactgcaccagccttggctacaggacttcctgcgggatgctggacacccggagcaacatctcgtacgcctacaacagtttctaccagaagaacgaccaagacgacgtggcctgcggcttctcgggctacgcgacgaccaccggccaggaccccagcaccgggacatgcaggttcgggatcatgatcgaggtcgactcggcctactcgtggaagccgacggcgggtccgaagcaactacctcctggtgcttctccttgcacttgttcacctctgcgtgtcatcctcataggtgttttttctttttctttgcggaagatggcccggccatgacagcatcaacagcctggcagcttagaggggtatttgatgcctgccgtcagtgttcatccatgtaggaacctttttcgatcgattttcttcgttctaatttcggtggatgcggacgt

SEQ ID NO: 4363 - DNA, 797 bp, Triticum aestivum
tttcgagcgccactgggggatctacacatacgatggcatccctaagtatcagctgaacttcggtgtgccgaattcacagattaaaagagcaagcggcgtcaagtaccttgacaagaaatggtgtgtgctgaagcctactgtcagcctcgacgacccaaagcttccagacacggtgagctacgcgtgctccagggcggactgcaccagccttggctacaggacttcctgcgggatgctggacacccggagcaacatctcgtacgcctacaacagcttctaccagaagaacgaccaagacgacgtggcctgcggcttctcgggctacgcgacgaccaccggccaggaccccagcaccgggacatgcaggttcgggatcatgatcgaggtcgactcggcctactcgtggaagccgcggctggtccgcagcaactacctcctggtgcttctccttgcacttgttcacctctgtgtgtcatcctcataggtgtttttctttttctttgcggaagatggcccggccatgacagcatcaacagcctggcagcttagagggatatttgatgcctgctgtcagtgttcatccatgtaggaacctctttccatctttttcttcttctaatttcggtgggtgcggacgtcgcagccgcatggttgaaaattcgtctcgttagcgtagctttgatcatccggtaccattgtgattgggatggtgatgcagtggaccatttatacccaggaatgtgagtgagggcatagctatcaacctgcaaatagtgatgactccagatcagtcatta

SEQ ID NO: 4364 - DNA, 561 bp, Triticum aestivum
ttcggacgatattcatgtgttcgctgatcttccctcctgacacagagacaccgggtcttgtcgaggagaagaaaaagaggccagagcttaccactatcatagcagattcatctggtggaatgaaggctgatgatgttgctatgaaggctctaaacggcatcaaatctgggaggtttattgtcccctgcaatttcgagggagcaatgttagctatagccacttctggtctaaccccccagagttccccgttaattgcattcgtggaggtgatcggtgctggactgatgcgatttgtagcactatgtttccagtggaattggttctctactattgagaactggtacgccaagaacaagaaacatgggtgaaagcccaaactagccctgagattcccagattttcataggactttatacaaccaataatgtacattgttatccctgcactgaatgtatatcccggttgtattttgggatacaaaatgtatatctgggttattatttttgaccagatatacttagcacgttgtacacttgtactggacagaaagttaatagtccc

SEQ ID NO: 4365 - DNA, 714 bp, Triticum aestivum
catgaaggcaacgcacccggcgagaccagtctcccggcgtccattgccatcatgtcatcgcaggcctgtcagtttgttttatgggtatactgcttactccgcgagcaagttcgcactaactggacttgcagagtcgctgcagcatgaggttgtttcggacgacattcatgtgtcgctgatcttccctcctgacacagagacaccgggtcttgtcgaggagaagaaaaagaggccagagcttaccactatcatagcagattcatctggtggaatgaaggctgatgatgttgctatgaaggctctaaacggcatcaaatctgggaggtttattgtcccctgcaatttcgagggagcaatgttagctatagccacttctggtctaaccccccagagttccccgttaattgcattcgtggaggtgatcggtgctggactgatgcgatttgtagcactatgtttccagtggaattggttctctactattgagaactggtatgccaagaacaagaaacatgggtgaaagcccaaactagccctgggattcccagattttcataggactttatacaaccaataatgttcattcttgtcctggactgaatgtatatcccggttgtactttgggatacaaaaatgtatatttgggttattattttttaccagatatacttagcacgttgtacacttgtactggacaggaagttaaaaatcccc

SEQ ID NO: 4366 - DNA, 1121 bp, Triticum aestivum
ggaggccgtgcttgacgttggtggtgtctatgatcccagccggcatcgctatgatcatcaccagaagggcttcaacgaggtctttggacatggctttaacacgaaacttagcagtgctgggcttgtttacaagcattttggtaaggagataattgcaaaggagcttcagcttaatgaggagcatgaagatgttcaccgtgtgtatcttgccatatacaaaagctttgttgaggcacttgatgcaatcgataatggaatcaatcaatatgacacagagcaaacccccaagtatgtgaacaatacacacttgtcttcacgtgttgggcgccttaatccagactggactgatccagatcaatcacctgagaaggaaaatgccgcatttcaaaaggcaatggcacttgccggaagtgagtttatggagagtgtccgctttcatgttaaatcgtggctacctgcaagatctattgtcatggagtgtttgctgtcaagaggaaatgttgatccaagtggagaaatcatggttttagatagattctgcccgtggaaacttcatctgtttgagctagagcaggagctgaagactgatcctctgaccaagtatgtgttgtatgaggatgagaggagcaaaggctggcgagtgcaggccgtctctgttgcacctgacagattcgagagccgaaaggctctcccagagaagtggaggggcatgagagatgatgaactgtccaaggaaaccggcatccctggctgtgtgttcatccatatgagtggcttcattggtgggaacaagacctacgagggagcgctggaaatggcaagagctgccctcaaatgctaattcaaccgaagcaacaagcagtaaaacagtcttacccatgttacgactgattgaggttcatatgcggcgctgcacttgcaccaattttattaccattgactagttggtatttgagtatgtatgttccgtggcgtgaaacatccacctgattagcagagattggtatccgtatgaggctgaacaagtagagttatatcatttgattaaagacgatgaaactcgttaatttgttgctcttcaccatttttttattactgctacaagcataagcgactgaata

SEQ ID NO: 4367 - DNA, 748 bp, Triticum aestivum
tcgaaggcaagctgcatccaggaagcagagcttaagcaagctatgctgacatggcagaagaacaaagaacagcgagaaacatatttctgagctgaatcaagaccttgccaatcttacaagcaagcttgaactgatattatcagagaaagacacagttgataacaagctggccactctactaactgacatcacagcacgtgatgaaaagatgaaacagatggatggccaccttagtcagcttcaacttgagcatgccaagatatcagcagagtccgctattgtgcatgagtccctgtcggagctgcgtgctcgggtttctgagctcgaggaacttgtggagaagcagaacctcgcgatctctgagggcgccgaggggaagcgtgaggcgattaggcagctgtgcttcacccttgagcattaccgcagcgggtaccagcagctgcgtgagatgctgcagcagggccacaggagaccaccgatgctgatggcagcctgaccaagtgtgtccttcttgttcccaatatccttttgtgcttacgaattgggttctgtagctttttcaattgagaagaactctgttatgtctgtgtgcaactacaatgtaatgtgaggatcatgtcagtcatggctcgcggaaaaaaagcaatcatgtccgtggtcttttgctcttgttacttctgttacattcttgtcatatattcaagatggtgaattctgtgttttggtctttaatgatgaagcggcgatg

SEQ ID NO: 4368 - DNA, 700 bp, Triticum aestivum
ttcatgagaggcctgaggagaaggttatcacagttggcatcgtcagcaatgcagagtaccgttacaaagagtcatcttgctgcgttaaggctgaatcagggctcggagtgggacttcgggtgttctcaggcatcgtcggcgtcgagaagcccgacccaacgatctacaagatcgcgctagagatggcggggaacgtcgcaccagaagaggcgctccacattggcgacagctaccgcaaggactatgtccccgcacgaagcatcgggatgcacgcgctgctcctggaccggttcaagaccgccgaagccgagagctggaggaagtctggcgcaccggtcctccctgacctcgaggccgcgcaggcatggctcaccaagaacccgacctaggaacccgctgaggagccactaggggccgcgctgctgcgcaggatggccgagaagctctgaatctcgcccctgggatagttcctgttgtgctcttgctgggcagtgagggagccaaggagaagggatgtgttgtagtgatggttcactggcctgtttagctagctggagctacttgaactctggtagtagcttcgggtactgttgctgactgctgaatgtggcaagtgattcagtcgtgcgacgaacatcttgcaacgacgaataattctaatcatgttttgcataatggagatatttaacatggttctgca

SEQ ID NO: 4369 - DNA, 1248 bp, Triticum aestivum
actcccgggaatgaatcagcttccccttccccttctctgagatctcagcccgagcctgcgcgccgcgacttccaccggaatccttccctcctagccgcaacatcgccggatcgattcaggcattcttggtggccggagaagcagtctttggtcctctgcttgagaatataactgttgttcagatcatcatcagacatgtcgctgctatcgaaattgcggctggttactgtggatgtgactggtactctgcttgcttacaaaggacggcttggtgattactactgcatggctgctaaggctgctggaaagccatgccctgattatgatcgaatgcacgaaggcttcaagcttgcatacactgagatggcaaggaaatacccatgctttggatttgcggcaaagatgccaacgattgaatggtggaggatttgtgtcaaggattcatttgttaaggctgggtatgattacgatgatgagacatttgataaagtgttcaagcgaatttattccgcctttggctcctctgcgccatactctgtttttcctgatgcacagcccttcatgagagggctgagggaaaaggggatcacagttggaatcgtcagcaatgcagagtaccggtacaaagaggtcatcttgcctgcgttagggctgaatcagggctcagagtgggacttcggggtgttctcaggcatcgtcggtgtcgagaaacctgacccaaaaatctacaagatcgcgctggagatggcggggaacgtcgcaccggaagaggcgctccacattggcgacagctaccgcaaggactacgtccctgcacggagcatcgggatgcacgcgctgctcctggaccggttcaagaccgccgacgccgagagctggaggcagtccggcgcgccggtgctccctgatctcgaagccgcacaggcatggctcaccaagaacccgaccgaggaacccgctgaggagccactaggggccgccactgctgcgcaggatggccgagaagctctgaatctcgcccctgggatggttcctgttgtgctcttgctggggagtgagggagccaaggagaagggatgtgttgtagcgatggttcactggccagtttagctagctggagctacttgaactctggtagtaggcttccagtgctgttgttgactgctgaatgtggccaagtgattcagccgtgcgacaaacatcttgcaatgacgaataattctaatcatgtttcgcataatggaggaa

SEQ ID NO: 4370 - DNA, 1199 bp, Triticum aestivum
cttcccctttcccttgtctgagatctcagcccgagcctgcacgccgcaacttccaccgaaatcctcccctcctagccgcagcgtcgccggattgattcagaaggcattcttggtggccggagaagcagtctttggtcctctgctcgagatcatcatcaaacatgtcgctgctatcgaagttacggttggtcactgtggatgtgactggtactctgcttgcttacaaaggacggcttggtgattactactgcatggctgctaaggctgccggaaagccatgccctgattatgatcgaatgcatgaaggcttcaagcttgcatacactgagatggcaaggaaatacccatgctttggatttgcggcaaagatgccaacgatcgaatggtggaggatttgcgttaaggattcatttgttaaggctggctatgattacgatgatgagacctttgagaaagtgttccagcgtatttattccgccttcggctcctccgcaccatactcggtgtttcctgatgcacagcccttcatgagagggctgagggagaagggtatcacagttggcatcgtcagcaatgcagagtaccgttacaaagaggtcatcttgcctgcgttagggctgaatcagggctcggagtgggacttcggggtgttctcaggcatcgtcggcgttgagaaacctgacccaaaaatctacaagatcgcgctggagatggcggggaacgtcgcaccggaagaggcgctccacatcggcgacagctaccgcaaggactacgtccccgcacggagcatcgggatgcacgcgctgctcctggaccggttcaagaccgccgacgccgagagctggaggaagtccggcgcgccggtgctccctgacctcgaggccgcgcaggcatggctcaccaagaacccgaccgaggagccactaggggctgcgctgctgcgcaggatggccgagaagctctgaatctcgccccctgggatagttcctgttgtgctcttgctggggagtgagggagccaaggagaagggatgtgttgtagtgatggttcactggccagtttagctagctggagctacttgaactctggtagtaggcttccggtgctgtggtgactgctgaatgtggcaagtgattcagccgtgcgacgaacatcttgcaatgacgaataattctaatcatgtttcgcataatggagaa

SEQ ID NO: 4371 - DNA, 959 bp, Triticum aestivum
gccgcaaaagggttatattggctatggatgctgcatttggcatggaatatttgcatgggaagaatattgtccatttcgatctcaagtgtgagaacctactggtaaacatgagagatccacaacgaccgatctgcaagattggtgatcttgggctatcaaaggtgaagcagcatactttggtgtctggtggtgttagaggaaccttaccatggatggcacctgagcttctgagtgggaaaagtgatatggtgtccgagaatattgatgtctactcatttggtattgtgatgtgggagctacttaccggggacgacccttattctgatatgcgtgcagctgaaattattgggggcatcgtgaacaattctcttcgtcctcagatcccttcctggtgcgatcctgaatggaaatcattgatggaaggtagttgggctggtgaaccagctcaaaggccatccttcactgaaatatctcaaaggttgcggaaaatggccgcggcaatgaatgttaaataaagggctcaatttattacaacgcgaagaggcatgtaaggaatcccatgtccagttccctgactagaggaaggcaaacccggaatatatgttacatgtgtcttggcagcgtctcggtttatcctagttgaaatgagattttatgaaggccttccatgggaggagaaactcatcacggacggttctaaagcgtatttgatgagtcgtcagctgccgccgtttgccttcaagtacgatatatatattgcatctgtccattcctcatgacgggaactgttggggtttgtaatgtaaataaattttggcccgctccgtccggcgcatggtaagaatgtggcacgggactagacacggtgcaaagctggacgcagttatccctttttctttcatacgattgtgtcctgagaaaaagagggaacgaactctggacaagagatatccttagtc

SEQ ID NO: 4372 - DNA, 820 bp, Triticum aestivum
gagctgcaggcgtggtggaaggaggtgcgcgaggtggggcacggcgacctcaaggtcgagccatggtggccgaggatgcaagccgtgggcgagctggccaaggcgtgcaccaccatcatctggatcgggtcggcgctgcatgcggcggtcaacttcgggcagtacccctacgcggggttcctccccgaaccggccgacggtgagccggcgccgcatgccggagccggggaccgagcagtacgcggagctggagcgcgacccggagcgggccttcatccacaccatcactagccagatccagaccatcatcggcatctcgctgctggaggtgctgtcgaagcactcctccgacgagctctacctcgggcagcgtgacacgccggagtggacctcggaccccaaggccctggaggtgttcaagcggttcagcgagcggctagtggagatcgagagcaaggtggtgggcatgaaccacgacccgcagctgttgaaccgcaacggtccggccaagttcccctacatgttgctctaccccaacacctccgatcagcaagggcgccgccgccgggctcaccgctaagggcatccccaacagcatctccatctgagcattcattgctacatactgcaccggcgccaaccacggcaaggcggcggccgacgttcatagtgatgagtgcgaataaagagtgtcgacacgtacgggaacgggaacatgttgatagactggtgctgtgtatgtgacactgtatgtgtgtgagttcatgtcagcaactgttcgatcctaagcgttaatcctcatgcatttggcaataaatga

SEQ ID NO: 4373 - DNA, 623 bp, Triticum aestivum
tgagccggcgccgcatgccggagcccgggacggacgagtacgcggagttagagcgcgacccagagcgggccttcatccacaccatcaccagccagatccagaccatcattggcatctcgctgttggaggtgttgtccaaacactcctctgacgagttgtacctgggtcagcgcgacacgccggagtggacctcggaccccaaggccctggaggttttcaagcggttcagcgagcggctggtggagatcgagagcaaggtggtgggcatgaaccacgacccggagttgaagaaccggaacggcccggccaagttcccctacatgctgctctaccccaacacctccgaccacaagggcgccgccgccggcctcaccgccaagggcatccccaacagcatctccatctgagcattcattgctacatacttctccggcgccaaccacggccaaggcggcgttcgacgttcttagtgatgagtgcgaataaagagtgttcgacacgtacgggaacgggaacgtgtcgacagactggtgttgtgtatgtgagactggatatgtgtgagctcgtgtcagcaactgttcgatgctaagcgttaatcctcatgcatttggcaataaataaag

SEQ ID NO: 4374 - DNA, 673 bp, Triticum aestivum
catccacaccatcaccagccagatccagaccatcatcggcatctcgctgttggaggtgctgtccaaacactcctctgacgagctctacctggggcagcgcgacacgccggagtggacctcggaccccaaggccctggaggtgttcaagcggttcagcgagcggctggtggagatcgagagcaaggtggtgggcatgaaccacgacccgcagctgttgaaccgcaacggcccggccaagctcccctacatgctgctctaccccaacacctccgaccacaagggcgccgccgccggcctcaccgccaagggcatccccaacagcatctccatctgagcatggtacatcggagcttcgtctcgtccacgccaaccacggtgcgtgcgcgtccgaataaagagcgtgcgactcgttcaccacgtacgggaacgtgtcgagagactagtgcagtgtgtgtgacactgtgtgtgagcttgtgtcagcaattgttcgatcacggtgttttttatttgtgtgttgctgttggccgtgtgcatcttagttatgcataggctggatgtgcttataaaaaaaattagcaataaataaagcatttaggtttccacggaaaccgtgtcatcataaagatgaattatgcacctgaacagacggagccggacttttcaactcgtaata

SEQ ID NO: 4375 - DNA, 821 bp, Triticum aestivum
acggggaaaggattctgcaaagcctccgaactcgcgacggggctgataatgaacaacatactgcgcatcggaaaggtgaatgtcatcggagacgtgatcctctacctgggaaagctgtgcgtgagcctgtccagcgtgctgttcgcgttcctcatgctggacacccacaagtacaggtctgctcacaacaagatatcgtctccgctgttccccgtgctgctgtgctgggcgctcgggtacgtggtggcacagctcttcttcggggtggtggaggcgtcggtggagacgataatcctgtccttctgccaggacgctgaggagcacgacggggaggcgcagtacgctcccccgctgctcatggagacgctgggcgacacgagccagctgcagaggctcacgcagggcccttgatggatcaaacctttgggcattgatcgactttggtagtgtagggttaccagaggcagctggttgggtgaatggctttgaccataataatactacgtgttatactattaattaactttgttgttaggtggaaatggaatgcaggcatgcctggctacggaccgtggaaaagacctctgctactagtgtcgatgaaatttcctttgtgatggggatggcaatcgggtaccggatggatggtggatgttgctccatgtctgaccgttcaacctatatccattctaggtataggtagtactggtactggctctcgttgttataatggaggtctagcaatgatgaaaggcgatcatcatggtgatgtgagcactggtgtaaagcaatggaatggatcctcgcaaaaaataaatgga

SEQ ID NO: 4376 - DNA, 784 bp, Triticum aestivum
  misc_feature (661)..(661): n = any nucleotide
tgacataccatttcataccgtggtgtcctccgtgaagcgtttgctgcgctacagccttggatctgtggctctaggttcactgatcgtatccagcgtggagtgggtgcggtgtatacttaaatcgctccgccgtaggctgaagggggttgattcaactggtgaaagccgcttggggaagacagtgtcatcctcatctcactgctgcttgggctgcatagactggaccatcaagtcagtgaaccggaatgcttatatcgtgattgccgttacagggaaagggttctgcaaagcctccgagctcgcgaccgggctgataatgaacaacatactgcgcatcggtaaggtgaacgtcatcggggacgtgatcctctacctcggaaagctgtgcgtgagcctgtccagcgcgctgttcgcgttcctcatgctggacacccacaagtacaggtctgctcacaacaagatatcgtccccgctcttccccgtgctgctgtgctgggcgcttgggtacgtggtggcgcagctcttcttcggggtggtggagacgtcggtggagacgataatcctgtccttctgccaggacgcggaggagcacgacggggaggcgcagtacgctcccccgctgctcatggagacgctgggcgacacgagccagctgcagagntcacgcaggggccttgattcgacccagcttctcggcattgatcgactttagtagtgtagggttaccagaggcagctggttgggtgaatggctttgaccataataatacgcactatatactact

SEQ ID NO: 4377 - DNA, 613 bp, Triticum aestivum
ccgtcgtcgtcaacaccacctacctcccaaacaatcgcgacgccgagatccgccgcaccctcaccgccgacggcaccctccggaagaagagggagatggcgacgcagcaggggatccaggagtcgtactacagggacatggccgtcatgttcggcaagtgggagttcgaccccatggcgctgccggagccgccgtgcccggtgcacctgtggcagggcgacgaggacggcctcgtgccggtcgcgctgcagcggcacgtcgccgggaggctcggctgggtcaactaccacgagctcccaggcaccggccacttcctgtccgccgttcccgggctcggagacaccgttctccggacacttttcggttgatcgaccaataccagacaagttagtttttagtccaagaaaacgtggagaagtgtttggcctttagctagcttggcgtacgaggcaaactggcaaagtgcaggacagtatgtctatttcttgattaatttatactactgtacatgggaacatgaggcagcatgtagattttgtatttcatactccttttttcattcgtttgtaatcaaaactatgctgacaaaaagcttagtagtaacatttttacc

SEQ ID NO: 4378 - DNA, 641 bp, Triticum aestivum
gcagttccggggcatcgcctttgggtggactgtgtgagggagaaagggaagagcggaaaggttgccggagctcaggctttggttatctgagaatgatggaagcgggcaagttccccgggataattggtgccgtaagcggccaggacggtggcgtcaacttctgcgacatggcatactaccagaagctaggggagggctccaccatgtccattgatagccttaacagcatgcagaccagcatgcacggtggttccataatgtctgtggacaacagtagtgttggttctactgactcgcgtactgggatgcttaaccatcctagccacaggggagctgttgctgtggtcagctactcggttgggaacagcattttccgtcctgggcgggtgtctcatgccttgagtgatgatgcgttggcacaggctttgatggacactagattcccgactgagacactcaaggattatgaggagtggaccattgatttggggaagctccacatgggattgccctttgcacaaggcgcatttgggaagctatacaggggggaaacggcaattaggatgacacattaagtttacggtgtcgcaactctgtgttgtaattcattctttagtgtagaagaggaagaagactgattg

SEQ ID NO: 4379 - DNA, 686 bp, Triticum aestivum
tataacagggaaacagaccagagccgtggatttgggtttgtcaccatgagtaccattgaagaggctgagaaggccgtggagatgttccatcgctatgacgtgaacgggaggctgttgactgtaaacaaggcagctcctagaggcgcccgggtggaaaggcctccccgtgattccgggtcttcattcaggatctacgtgggcaacctgccatggcaagtggacgactctaggttggtagagctgttcagcgagcacggcaaagttgtcgatgccagggttgtctacgacagagacactgggcgctcacggggatttggtttcgtgacaatggcatcacagccggaacttgatgatgccatcgctgccctcgatggacagagcttggaggggcgtgctctgcgggtgaacgttgcggaggagcggccaccacggaggttctaatgaaggtgtatttgatggtggactacgacaagattgctgcgtaagagacacgatagcacgcccaataccggcttagaccccccatccatccttgtgccatgtctgcctcctctctctccagtgtttttctcttttgctatctgcctgttgcttccacgttctcaatctgtcgatgcaattcaaaagttttgtctgacatactacatatgtttaagccccccatatggggtgcgtcgccctgagat

SEQ ID NO: 4380 - DNA, 1012 bp, Triticum aestivum
aagcaacatgatgcggacgatgctcagtcattctacactctgagctgggcttgtgacctgacggcacaccactgctagtggcagcaggaagcaatgcggtcattcgggtcatcaactggtgccaccgagaagttgtttaagagttttcttggccatggtgattcaataaatgagataagaactcaaccattgaagccttcgctcttcatttctgcaagcaaggacgagtctgttaggctatggaatgtccatacaggtatctgcatcttgatttttgctggaggaggaggtcaccgtaatgaagtattgagtgttgacttccacccttctgatatctaccgaattgccagttgtggcatggataatactgttaaaatctggtcaatgaaagaattttggccatacgtggagaaatcctttacatggactgaccttccatcaaaatttccaacgaaatttgttcaatttccgctcatgacttccgtggttcattctaactatgttgactgtactaggtggcttggtgacttcatcctgtcgaagagtgttgacaatgaaattgttctgtgggagccaaaaataaaagagcagggtcccggcgagggtagcattgatgttcttcagaagtaccctgtgcctgattgtgacatttggtttatcaaattctcatgtgattttcacttcaatcaattagccaataggcaaccgcgaaggcaaaatctatgtgtgggaagtgcaggcgagccctcctgtgctaattacccggctgagtagtccgcaatgcaaaatgccaataaggcagactgcagtgtcgtttgatggaagcacgatccttgcctgcggcgaggatggcagcatataccgctgggacgaagtggaacatcaagctgcaaaaaattgaagcaaccgaaaaccaccatgccgtgcgaccccatggcaatgccagccagtttgagcttgacttgggtagttgttgtgttgctacttagtgggttgtacccattacttagtc

SEQ ID NO: 4381 - DNA, 917 bp, Triticum aestivum
gcaacacaagaattttatccgcttaactgctgcccgtcgcaaatggaggcagcggcagcagcggctagctcctctgtcctgctgtcattttccagcccggggagatcaacggcggctaccttcctccgcctctccacggcgtcgcctcgcatcacatgctccgccacacagcagcttcccctcgctgcgccatggttgtaacctccgacaagagcagcagcagaagaagaagttcttgtcgctgaggtgctcctccgcttccaccggcagcccgtcggccgtcgtctcttcggaacgatggattcttgagcccgcaggagacggcgactggaaacacatcggctaccgcgtcgctcggcccggcgccatggagatcgcctccgaagcgataaccgtgggacgagttccggagaacgccgacgtcgtcatccccgtcgcgacagtttctggggtgcacgctcggctggagaagaaggacgggaacctggtggtcacggacatggacagcaccaacggcacctacgtcaacgagaggaagctggtgcccggattcccggttgccgtccaacccgggagcctcctcatcttcggtgacatccacttggcaatgtttcgggtgaggaaggagattgtcgatgtgccagccaaggccaccaaagatgaccagcaggaatctgagactgtgctggcaagtgcagttcaagaaacaagctagtgtaccttacctttcaaaataagggtgcaaaatagtgcatcatggtaatatacagtctccgtctctggatcgacaaaatatgtagctaggcagaaatagcttgcgagtaaacccatacaatttttgcaaagcataggcagattgtttctgctttatcaatgtccaacaaccatggaatggcaaacgggacagagccaataca

SEQ ID NO: 4382 - DNA, 1020 bp, Triticum aestivum
taatgagttaaccatacccacatggtagcaagcacgatggccaggataggacatttggacacctgccaatccatcacaatcagagctctcctatctcctccaccctccgtggggaggacacagcctctccacctgagcaacacaagaattttatccgcttaactgctgcccgtcgcaaatggaggcagcggcagcagcggctagttcctctgtcctgctgtcgttttccagcccgaggagatcaacggcggctaccttcctccgcctctccacggcgtcgcctcgcatcacgtgctccgccacacagcagcttcccctcgctgcaccatggttgtcagccgccgaaaagagcagcactagaagaagaagcagcatcctgtcgttaaggtgctcctcggccgccaccggcagcccgtcggccgttgtctcttcagaacgatggattcttgagcccgcaggggacggcgactggaaacacatcggctaccgcgtcgcccgccccggcgccatcgagatcgcatccgaagcgatgaccgtgggacgagttccggagaacgccgacgtcgtcatccccgtcgcaacagtttctggggtgcacgctcggctggagaagaaggacgggaacctggtggtcacggacatggacagcaccaacggcacctacgtcaacgagaggaagctggtaccgggattcccggtcgccgtccaacccgggagcctcctcatcttcggtgacatccacttggcaatgtttcgggtgaggaagacaatcgtcgatgtggcagccgaggccaccaaagatgaccagcaggaagctgagactgtgctggcaagtgcagttcaagaaacaagctagtctaccttacctttcaaaataagagtgcaaaatagtgcatcatggtaatatgcagtccccgtctcaggatcaacgaaatatgtagctaggcagaaatagcatgtacgagtaaagagtaacttgcaacatgtcatgctcaaggaacaggtcattcaaacaacaca

SEQ ID NO: 4383 - DNA, 765 bp, Triticum aestivum
catctcgttgctcatagagccgatgatgttgattactggcttcttcctcctgtttgttgcatgtattgcctacatgcacactgacatgtcaatctctaagaactctccttcttatctggcaaagctgcaatgggatgaggtgcaagccactgttcagcaaatccagggcatctttcaccagtgcttagctgttcatgataagctagagacatcattgcacgatttgtctaggtctggagacgctaaatcttgcaaagcagctcgtaaagccgctgatgcacagtttaaggaattagcgaaagagctgaagccgctgttgttatctgtacagtcatcccctcagtcttatcagatatggccaaagctagaggacttggttgcgaaggagagggagatgcaggagaagctcatggcgaggcatgccaccgtggttgacagcgtcgagaagaagcagcgcgggcaagacatagaaaaccggatttcctcccagcagcagaagatcgctgcgctgaggcaagaggtcgaatctcttctagagtaccttagcgagatatgagcgaatccggtctcatcttacatgattagtgattagactgaaggtcatcttctgcactttgtgtagatgttgtgttggtaacccattatcctagttcctgaggctaggtttcctagactctgtaatgtgatataagcgccttaatcattttggaactgattaatttttttgcatcatctaaaaagaaatcatggggaaccacccccttg

SEQ ID NO: 4384 - DNA, 652 bp, Triticum aestivum
tgttcatgataagtctagagacatcattgcactgatttgtctatggatctggagatgctaaatcttgctaagcagctcgtaaagcagttgatgcacagttgaaggaattagcgaaagagctgaagccactgtggttatctgtacagtcatcccctcagtcttatcagatatggccaaagctagaggacttggttgcgaaggagaaggagttgcaggagaagctcatggcaaggcatgccaccgtggttgacagcgtcgagaagaagcagcgcgggcaagacatagaaaaccggattgcttcccagcagcagaagatcgctgcgctgaggcaagaggtcgaatctcttctagagtaccttagcgagatatgagcggacccggtctcgttcctatatcattagtgattagactgaaggtcttcgtctgcacttttgtgtagatgttgtgttggtaacccattatcctagttcctgaggctaggttttgaatagaccgtgtataacatgatataagcaccgtaatcattttggaactgattagttttttttgttttgcatcatgataaaaagaaatcatgcggaaccaccccccctctggactcctttttcttaagtggtagcataattgttccagattagtggtgcatttgcat

SEQ ID NO: 4385 - DNA, 757 bp, Triticum aestivum
atagaccgatgattttgattactgggcttcttcctcctgtttgttgcatgtattgcctacatgcacactgacatgtcatctctaagaactctccttcttatctggcaaagctgcaatgggatgaggtgcaagccactgttcagcaaatccagggtatctttcaccagtgcttagctgttcatgataagctagagacatcattgcacgatttgtctaggactggagacgctaaatcttgcaaagcagctcgtaaagccgctgatgcacagtttaaggaattagcgaaagagctgaagccgctgttgctatctgtacagtcatcccctcagtcttatcagatatggccaaagctagatgacttggttgcgaaggagagggagttgcaggacaagctcatggcgaggcatgccaccgtggttgacagcgtcgagaagaagcagcgcgggcaagacatagaaaaccgcggtggcatcccagcagcagaagatcgctgcattgaggcaagaggtcgaatctctcctagagtaccttagtgagatatgagcgaatccggcttcatcctatatcattagtgattagactgaaggtcatctgcactatatgtgaagatgttggtaaacccattatcctagttcctgaggctaggttttgaatagaccgtgtaacatgatataagcaccgtaatcattttggaactgattaacctttttgcatcatgataaaaagaaatcatgggggaccgcccccttgggactcc

SEQ ID NO: 4386 - DNA, 738 bp, Triticum aestivum
ccagacgaacagggctcgcaacggtgagctgtatcgctacattgctgatactcatggtgcctttgtgcagccagctttgtatgaagcatttggtctcactgttgtggaagccatgacctgcggactccctacttttgcaacactccatggagggcctgccgagattatagagcacgggatctctggtttccacattgatccttaccatcctgatcaggctgccacgttgatggctgacttctttgaaaaatgcaaacaggaccccaatcattgggttaagatatctgacagaggcctccagcgcatttacgagaagtatacatggaagatttactccgagaggttgatgacactggctggagtttatggcttttggaagtacgtttcgaagcttgaaaggcgggagactaggcgttatcttgagatgttctacatattgaagctccgtgagctggtgaagagtgtgccgcttgcaatagatgaggcgcattaactgttccgtctccaataaaagtcatctacttatttgtccagcgatcggtgaactcgccttttttactttacattgcgagtgttgaactggggtttgagtgtgctcgctatgtacatgagtgattgatacactgttggcaaattgtattttgccacgttgcttgtatttttaaagcttctgctaagacagaattcactagcctgctatctcatgtggaatctgctctactattttttgaccccgtt

SEQ ID NO: 4387 - DNA, 855 bp, Triticum aestivum
ggaaaatgtcaggttttgggcaccgtgtgtataagaattatgatcctcgtgctaaagtcatccgaaagttagcagaggaggttttctctattgttggacgggatcctcttatcgaggttgctgttgctttggagaaggcagcactgtcagacgattattttatcaagaggaagctgtatccaaatgtggatttttactcaggcctgatttacagagcgatgggattccctacagaatttttccctgtgttatttgcaattcctcgcatggctggttggctagcacattggaaggagtcacttgatgaccctgacaataaaattatgaggcctcaacaggtatacacgggcgtttggctgaggcactacacccctgtgagggaacgagtggcatctaaccagggcgaggagctcggtcagatcgctgcatcaaacgcaacgaggcgtcgccgtgctggttcttccctgtagaacagcagcaggcacggatgcatggtgcagcatccagcccacgcaataaaccaggctgctgtcgttgcccctcacaacgccgcagcggctcgagtccgggagctgttatccttctggtgtcaccaagacacttagcagttgccatgcaataaacttctagtaaaaggcacgctgtggacactatctatgcacacacttccagtttccagcttcatctctgcatgcatgcaatgtgagctcatgattggaaaaaataatcatactccctccgtcccaaaataagtcttaactttagagggagtagttgatggcatgtcggtcttcgtaagagtgtgcatattagtgcggtgcgtaggattcgatcctggccagcaatgaaaaatca

SEQ ID NO: 4388 - DNA, 573 bp, Triticum aestivum
gaagcttgtggccgcaggatcaatggattcgtcaaacgtgctagagctgccaagatacatgcttatataattgggcatctaaagaatcagatgcctacgatgatggggaaagctaaagcccagcagaaacttatagacaatttggagggcgagtttgcaaaggtgcaaagggagcatcatcttccagcaggggatttcccttacgtggagcacttcagagaagcattgggcgggtacagcatcgacaggttcgagaaggtgaagcccaagatgatccaggcggtggacgacatgctcgggtacgacatcccggagctgctcaagaacttcaggaacccttacgagtgagcagacatcatgatggaaagaccggcttcggtctcaggcgtagatggtggtagccagtctagtagggtattttattgctatattgtacccattgctgtgtaactgtatgcataagagccagaagcaattgctcaattgttggctggagaacggccttgttgtaatggcatggaaagaattcggaatatggtatggtggggtggtcgcgttgatccttgagatgat

SEQ ID NO: 4389 - DNA, 804 bp, Triticum aestivum
tgagtttcgcgcgttatatattggatcgttcaatgataaccagtaaaggaatcagctgttgggcccgatcggaaaggaactatttgagaaagagcaggatgatctcctttctgatctaaaagatataccaaagaaagcttgtgaccgcaggatcaatgaattcgtcaaacgtgctagggctgccaagatacatgcttatataattgggcatctaaagaatcaaatgcctacgatgatggggaaagctaaagcccagcagaaacttatagacaatttggagggcgagtttgcaaaggtgcaaagggaacatcatctccccgcgggggatttcccttacgtcgagcacttcagagaagcattgggcgggtacagcatcgacaggttcgagaaggtgaagcccaagatgatccaggcggtggacgacatgctcgggtacgacatcccggagctgctcaagaacttcaggaacccttacgagtgagcagacatcatgatccgaagaccggcttcggcgtgtcaggcgtggatggtggtgggtgcccatagagttgcggctgccagtctactagggtatttattgctacactgtacccattgttgtgtaactgtatgaataagagccagaagcaattgctcagttgttcgctggagaacgcccttgttgtaatggcatggagagagttcggaatatgggatggatggtatggtggccgtactgatccttgagatgattgtctattcgttccgaggaacagcttgaatgctttgctggtgcgatccagtcaactggctacccatgaagag

SEQ ID NO: 4390 - DNA, 645 bp, Triticum aestivum
caggatgatctcctttctgatctaaaagatataccaaagaaagcttgtgaccgcaggatcaatgaattcgtcaaacgtgctagagctgctaagatacatgcttacataattgggcatctaaagaatcagatgcctacgatgatggggaaagctaaagcccagcagaaacttatagacaatttggagggcgagtttgcaaaggtgcaaagggaacatcatctccccgcgggggatttcccttacgtggagcacttcagagaagcattgggcgggtacagcatcgacaggttcgagaaggtgaagcccaagatgatccaggcggtggacgacatgctcgggtacgacatcccggagctgctcaagaacttcaggaacccttacgagtgagcagacatcatgatcggaagacggctttggttcgcagttcgacatgtcaggcatggatggcggtggctgcccatagggttttggctgccagtgtagtagggtgttcattgctactgctacattatacccattgttgtataactgtattatgcataataagagccagaagcaattgctcagttgttcgctggagaacggcctttattgtaatggcatggaagtcggaatatgggatggtggttgtatcttatcctgcag

SEQ ID NO: 4391 - DNA, 718 bp, Triticum aestivum
ggttccgcgactgcgccggatacgccgcagagccgcgaccagtggcgctgcgcgttgcgcaccacgccccccgcatcatacactggtggatggagcagagctgctgcccctgcccacctccaccgtcgtcgtcaacactacctacctccccaacaagcgcgacgccgagatccgacgcaccctcaccgccgacgacaccctccggaagaagagggagatggcgacgcagcaagggatccaggagtcgtactacagggacatggccgtcatgttcggcaagtgggagttcgaccccatggcgctgccggagccgccgtgcccggtgcacctgtggcagggcgacgaggacggcctcgtgcccgtcgcgctgcagcggcacgtcgccgggaggctcggctgggtcaactaccacgagcttcccggcaccggccacttcctgtccgccgttcccgggctcggagacaccgttctccggacacttttcggttgatcgaccaataccagacaagtagttttagtacaagaaaacgcggagaagtgttggcctttagctagcttggcgtacgaggcgggacagtatgtctatttcttgattaatttataccactactgtacatgggaacatgaggcagcatgtagattttgtatttatactccttttttcattcgtttgtaatgaaaactatgccgacaaaagcttactagtgacatttttacc

SEQ ID NO: 4392 - DNA, 1101 bp, Triticum aestivum
tttcggtctcagtaccatttctgaatgcagaaggcttgacgggttgctccacacatcctgtggtacgcctgcttatgttgctcctgaagtaatcaataggaaaggctatgacggcgccaaggctgacatctggtcatgcggggtgatcctctttgtgcttttggctgggtatctccctttccaagataagaatctgatgaatatgtataagaagattgggaaagcagagttcaaatgcccgagttggttctcttcagacattcgaaggcttctgctaaggattcttgatcctaaccccagcacaaggatctcgattgagagaatcatggaacatccttggttcaggaagggtctagatgcaaagctgctcagatacaatttacaagcaaaagatgccgttcctgctgctgacatgactgcgacttctgattccttgagctgcagcaactcagcaacagagggcaaggaacaagaagcaaaaaagctctccaacttgaatgcttttgatataatctccctctcaactggactcgacctctccggtatgtttgaggacaatgacaagaagagggagtccaagttcacatccaccaactcggcttcgacgatcgtgtcaaagatcgaggacatcgcaaagtgcatgcgactgaagctcgtcaagaaagatggtggcatgatgaggatggaaagcttcaagcctggaaggaaaggtgtgatgtccattgatgctgagatatttgaggtcacccctgacttccatctcgtggagttgaagaagacaaacggtgatactatcgagtaccagaaggtcttgaaccaggagatgaggccagcgctcaaggacatagtctgggcgtggcaaggcgagcagcagccgcagccgcagccgcagccacagcagcaaccatgttaagaagaactgtgccaggtgcaacattttgcaactcgaggcaatcaattaccaggcgtccgtgtgtttctgtaatttttattatccatgtttgctattcgtttgcattcccctagtgatgtctgtgtaaacttcagttatcatctttcgatgaagatttatttaaaagcatggtgtcttcagaacagatg

SEQ ID NO: 4393 - DNA, 855 bp, Triticum aestivum
attctgatccaaaccccagcacaggatctcgatgagagaatcaggacatccgtggttcaggaaggtctagatgcaaaactgctcagatacaatttacaagcaaaagatgccgttcctgctgctgacatggctgcgacttctgatttccttgagctgcagcaactcagcaaccagagggcaaggaacaagaagcaaaaaagctcgccaacttgaatgctttcgatataatctccctctcaaccggactcgacctctctggtatgtttgaggacaatgacaagaagagggagtccaagttcacatccaccaactcggcttcgacgatcgtgtcaaagatcgaggacatcgcaaagtgcatgcgactgaagctcgtcaagaaagatggtggcatgttgaggatggaaagcttcaaggctggaaggaaaggtgtgatgtccattgatgctgagatattcgaggtcacccctgacttccatctcgtggagttgaagaagacaaacggtgatactctggagtaccagaaggtcttgaaccaggagatgaggccggcgctgaaggacatagtctgggcgtggcaaggcgagcagcagccgcagccgcagcagcaaccatgttgagaagaactgtgccaagtgctacattcattttacaacttgaggcaattaccaggcgtccgtgtgtttctgtaatttttattatcgtaagtttgttattcgtttccattcccctagtgatgtctgtgtaaacttcagttatcatcttttgatgaagatttatttgaaagcatggtgtcttcagaacagatgccaagtctttgtccaaaggctctccagggcagtgcgtttgtgtatggga

SEQ ID NO: 4394 - DNA, 807 bp, Triticum aestivum
gattcttgatcctaaccccagcacaaggatctcgattgagagaatcatggaacatccttggttcaggaagggtctagatgcaaagctgctcagatacaatttacaagcaaaagatgccggtcctgctgctgacatgactgcgacttctgatcccttgagctgcagcaactcagcaacagagggcaaggaacaagaagcaaagaagctctccaacttgaatgcttttgatataatctccctctcaactggactcgacctctcaggtatgtttgaggacaatgacaagaagagggagtccaagttcacatccaccaactcggcttcgacaatcgtgtcaaagattgaggacatcgcaaagtgcatgcgactgaagctcgtcaagaaagatggtggcatgatgaggatggaaagcttcaagcctggaaggaaaggtgtgatgtccattgatgcagagatattcgaggtcacccctgacttccatctcgtggagttgaagaagacaaacggtgatactatcgagtaccagaaggtcttgaaccaggagatgaggccggcgctgaaggacatagtctgggcttggcaaggcgagcagcagccgcccccgccgccgcaatcatgttaagaagaactgtgccaagtgcaacatttttacaatccgaggcaattacaaggcttccgtgtgtttctgtaatttttattatcgaaagtttgttattcgtttgcatgtctgtgtaaacttcagttgtcatctttcgatgaagatttatttaaaagcatggtgtctttagaacagatgcctagtcttta

SEQ ID NO: 4395 - DNA, 741 bp, Triticum aestivum
tattctgaggcagacgcgtaaaacgcagaatcagcggtgattcttcccccggtgctctttctgcttttctcggcatttctccttggtgccatcttcaaaaaagtgttgcaacatcttgacttacccattaatcaggtgcaaggtcatgattcaggctgcagaccccgatgaggacgacgaggacgaatctgaaaagccaggcaattcaaggcctcccaaacaatgttgggcgccatgcatgcaatgtggaacaaggaaggcatcccagggttcttcaaagggttacatgctcagatactaaagacagttctgagctccgcattactgctgatgataaaagagaagatttcaaagttcacttggatctcgctgcttgccctgcggcgatatctctttgtttctcggaagagaatcaagagtgcatagttgtatcatgcatatgtcagacctgagaaaaccagtctaatcgtccactggtatttcaagatcgtattataccaaataacagaagtacagaagcagaacagcacgatcatcttgagagcgccatggaatgttctgaataaatttgtttgtttttccatgtagtagctctgagcatctgattcgtacttggaatgtaatggaatgaagtggaataggtgttgtccagaagtagttctggtgatgtgattgtggtctggtagactggtaccatacgtgtaaaatatcacttttgttctattctttcctttctttgct

SEQ ID NO: 4396 - DNA, 678 bp, Triticum aestivum
gtgattcttcccggttgctctttctgctttctcggcatttctccttggtgccatctcaaaaagtgttgcgacaatcttgacttacccattaatcaggtgcaaggtcatgattcaggctgcagaccccgatgaggacgacgaggacgaatctgaaaagccaggcaattcaaggcctcccaaaacaatgttgggcgccatgcatgcaatgtggaacaaggaaggcatcccagggttcttcaaaggattgcatgctcagatactaaagacagttctgagctccgcattactgctgatgataaaagagaagatttcaaagttcacttggatctcgctgcttgcgctgcggcgatacctctttgtttctcggaagagaatcaagagtgcataattgtattatatatttcagacctgagaaaaccagtctaatcgaccactggtatttcaagatctcatactaccaaataacagaagtacagaagcggaacagcacgatcatcttgagagcgccatggaatgttctgaataaatttacttggttttttcccgtgctctgtgcagaagtagttctggtcaggttctggtgatgtgattgtggtttggtagactggtaccatacgtgtaaaaatatcacttttgttctattctttctttctttgctggaattgaagcatagcataa

SEQ ID NO: 4397 - DNA, 1054 bp, Triticum aestivum
caccgtggttgaccagcttaacagaagctattctgaggcagacgctgtagaaatgcagagtcagcatggcgattcttccccagttgctcttttctgctttctcggcatttctcccttggtgcccatctcaaaaagtgtgcaacaatcttgacttacccattaatcaggtgcaaggtcatgattcaggctgcagaccccgatgaggacgacgaggacgaatctgaaaagccaggcaattcaaggcctcccaaaacaatgttgggcgccatgcatgcgatgtggaacaaggaaggcatcccaggcttcttcaaaggattacatgctcagatactaaagacagttctgagttccgcattactgctgatgataaaagagaagatttcaaagttcacttggatctcgctgcttgccctgcggcgatacctctttgtttctcggaagagaatcaagagtgcataattgtatcatacatatgtcagacctgagaaaaccagtctaatcgtccactggtatttcgagatcttatactaccaaataacagaagtacagaagcagaacagcacgaatcatcttgagagccccatggaattttctgaataaatttacttggttttttcctgtagctctgagtatctgatactttgaatggaatggaataggtgttgtacactgtccagaagtagttctggtgatgtgattgtggtctggtagactggtagtactatacgtgtaaaaatatcacttttgttctattctttctttctttgctggagatgaagcaatagcaataaatctttcatgttgtaagtttcgcgccctaccctaaggcttaatgtcgaaagaattttcgcttggcgcattcaaattttgctttggcaatggcacgcggaccgccgggacgagcaggaggtcgaagcgccggcgcgtggtgagccccagcagctcggccatgtccagctccccgggctccggcccgtccggcagctcccagtcgaagtggtagagaaggctggcgagcgcgagctccatgtgtggcagccgaacgccatcccgg

SEQ ID NO: 4398 - DNA, 651 bp, Triticum aestivum
tcagctcttcccccgtcgcgagcgccaagaagctgcagcgcgagagggagatgctggcgaggcagatgcagaagcggctgtccgtggaggagaggaaccacatgtacaccaaatggagcgtgtcgctggactccaagaagaggaagctgcaggtggctcgccggctgtggacagagagcagggacctggagcacgtgagggagagcgcgtccttggtggccaagctgatcgggctccaggagcccgggcaggtcctgagggagatgttcgggctcagcttcgcgccgcagcagccccccgcccggcggtcctccaacggctggagatacgggatcccctcgtttggctgattgattgggcccctgacgacaagaggcaagaagatgacaggatgatgcggctgaccaaaagatctttttttttctctggtggttttgtatcttggggtgttgcctgttctgattttccatagggtatcaggacacgcgcatgcggggggtttgatcttggtgcatgccctttgcgtgtaggacgaccggtttggtgcgcggttcctgagcaggcgccgccggtctgattgctaacattattaacgtatcactgcgtatccagagacacgctcttttgttaacgtgttgttgcattcccacg

SEQ ID NO: 4399 - DNA, 750 bp, Triticum aestivum
gacggccttcgccgccgttaccgtgcggcttctctacagctcctcccttgccgagccgaggtccatcccgtccaagtccatgtaccccaccttcgatgttggtgatcggattctcgctgagaaggtgtcatatgtattccgggaaccagaaatcttggacattgtcatcttccgtgctcccccagctcttcaggatatgggctacagctccggtgatgtgttcatcaagaggttttgccaagggaggggactacgtcgaagtgcgtgatggcaagttactggtcaacggggtacttcaagatgaagaatttgtgctggaggcacacaactatgagatggaaccattgcttgtaccggaagggtatgtgtttgtgctgggagacaaccgtaacaacagcttggactcccataactgggggccgctcccggtgaggaacatacttgggagatccgtgttccggtactggccaccgtcgaagataacggatacaagatactaccaacccgatgcggcgctctacgcggtggggatgtcgtgacgactcgtgcctccggtgatgctgtggcaaccaacgcgctccgccgatgggctgagcttcaatcctcttgtttcattgagagtttgtatttagaactgtggatgaattcctgttccgttcgtttttcgctgcctactggcaggcgcttgttgaataaccacgaaaagcatggttatgtgtagagagagagagagcagctgctgagggagca

SEQ ID NO: 4400 - DNA, 660 bp, Triticum aestivum
cgcgcttactgctaccaatccaagctggatgaactgagcactatcgccgttgccaagggcgatatcggtgatggagaagacgtgctggtgagggtgcattcagagtgcctgaccggcgacatcctcggctccgcccgctgcgactgcggcgagcagctggacctcgcgatgcagctgatcgagaaggccggtcgcggcgtcctcgtgtacctgcgcggccacgaaggccggggcatcgggctcggccagaagctccgcgcgtacaacctgcaggaccaaggcagcgacacggtggaggccaacgtcgagctcggcctcgccatcgactcccgcgagtacggcatcggagcccagattctgagggacattggcgtgcgcacgatgcggctgatgacgaacaacccggccaagttcgttgggctcaaggggtacgggctcgccgtggtgggccgggtcccggtgatctcgccgatcaccaaggagaaccagaaatacctcgagaccaagaggaccaagatggggcacctctacggctccgaccttcccggcggcctcctcaaggaattcctcaatcctacggaagacaacgccacgaactaattatacacccaccacacgatccgcatatcattttctgtaacttcattctttctgatataa

SEQ ID NO: 4401 - DNA, 718 bp, Triticum aestivum
gagatgattgacgatgacatctacgtcgggcagagaacagctacaacctcttcactgtgcgcaagaatagcgacgcggccacagacgaggagaggggtaggctggaggtgtcggggagtaccacctcggagagtttgtcaacagatttccggcacggctcgctggtgatgcgcctccctgactcggtagatgggccagatccccacggtcatctttggcaccatcaatggggtcatcggcatcatcgcctccctgccccacgaccactatgtgttcctggagaagctccagacaaccctggtcaagttcatcaagggtgtgggcagcctgagccacgagcagtggcggtcattccacaacgacaagaagacgtcagaggcccgcaacttcctggacggtgacctcatcgagtcgttccttgacctcaacaggtccaagatggaggaggtggccaaggcgatggcggtccccgtggaggagttgtccaagcgggtggaggagctgatgagactgcactaggtggtagcgccgggccgtgtatatcctgttttatttgttcgttttcgctgtgttgtaaaccgttggcggctcgagaatggtcctctgcaagtgtttgtagcaacatccctcttctgtttttgactttgataagagtgtaactttgtctgtgctgatgtagaattttagtggtgaatctctctgtcgaaatggtatcaag

SEQ ID NO: 4402 - DNA, 806 bp, Triticum aestivum
gatcaagagctgctaggactacaacccaactggatgactgcagtgagatgatgagacgacatctatgtcggtgcagagaacagctacaccttttcaccggcgcaagaacagcgatgcagccacagatgaggagaggggcaggctggaggtggtcggggagtaccacctcggagagtttgtgaacaggttccggcacgggtcgcttgtgatgcgcctcccggactctgagatgggccagatccccacggtcatcttcggcaccatcaacggggtcatcggcatcatcgcctccctgccccacgaccactatgtgttcctggagaagctccagacaaccctggtcaagttcatcaagggcgtgggcagcctgagccacgagcagtggcggtcgttccacaacgacaagaagacgtcggaggcccgcaacttcctggacggcgacctcatcgagtccttcctcgacctcaacagggccaagatggaggaggtggccaaggcgatggcggtccccgtagaggagctgtccaagcgggtggaggagctgatgagactgcattaggtggtagcgccgggccgtgtatatcctgttttattcgttcgttatcgctgtgttgtaaaccgttggcggcttgagaatgatcctctgcaagtgtttgtagcagcattccttttctgttttttgactttgataagagtgtaactttatctgtgctgatgtagaattttagtggtgaatcgccgtggtttatgtgcaattgtcaacatgacacccagaaagtttggcataattgttaggcgtatgtaaa

SEQ ID NO: 4403 - DNA, 674 bp, Triticum aestivum
cagacgaggagagggcagctggaggtagtcggggagtaccacctcggagagtttgtgaacaggttccggcatggctcgctggtgatgcgcctccccgactctgagatgggccagatccccacggtcatctttggcaccatcaacggggtcattggcatcatcgcctccctgccccacgaccactatgtgttcctggagaagctccagacaaccctggtcaagttcatcaagggtgtgggcagcctgagccacgagcagtggcggtcgttccacaacgacaagaagacgtcggaggctcgcaacttcttggacggcgacctgatcgagtcgttcctcgacctcaacaggtccaagatggaggaggtggccaaggccatggcagtccctgttgaggagctgtccaagcgggtagaggagctgatgagactgcactaggtggtagcgccgggccatgtatatcctgttttatttgttcgttttcgctgtgttgtaaaccgttggctgctcgagaatgatcctctgcaagtgtttgtagcaacatcccttctctgtgataagattgtaactttatctgtgctgatgtagaactttagtggtgaatctctcttgttgaaatggtatcaagaaagtttggcacaattactaggtgaacgtagacggtgataaccatctgg

SEQ ID NO: 4404 - DNA, 575 bp, Triticum aestivum
ctacgacgatggctctgtccaaaagattactgagatcccagatgatctgaaagcaatttacaagactgtttgggagatcaagcagaaaactgttgttgacatggccgtcgatcgtggctgctacatcgatcaaagtcagagcctcaatatccacatggatcaagcaaactctgggaagctaacttccctgcacttccacgcttggtccaagggcctgaaaacagggatgtactatctgaggacacgtgctgctgcggatgcgatcaaattcacagtggacactagtcttctcaaggataagaagcctgcgaatgccgaggaggaagaggatctccaggccaagatggcgcaggtgacctgctccctgtacaaccgtgaggactgcttgtcatgtggaagctagattcgtccgcgacaccctacgctaacctatactatcgtcttactgttggcttgtcgttggattcagatgatatatctctgcctatgcatgatgagctcatgaattaaaaagcaagccttgctcctagacactctgaactcatggtatcgtgtctgtatatatatatagccac

SEQ ID NO: 4405 - DNA, 677 bp, Triticum aestivum
tgcttccgtatgccgcctgggtcaagaatgacacgctcagcttcgagatcaatggcgaccctggaaaggaggatgaggctaaggccagtggccgtggcatggggcgcatccgccccacggccggtaagaagatgtccggcaaggtgcgcagtgtgcaggcatttgatttcgccgagtggctgaagcagacggtgtcggagcaggactacgtggtgatgaagatggatgtggaggggactgagtttgacttgatcccgagactcttcgacacgggcgcaatctgcttggtcgacgaggtgttcctcgagtgccattacaaccggtggcaaaggtgctgccctggcgagcggtcgcccaagtatcagaacacatacgaggagtgcctggagctcttcagctcgctccgggagagcggcgttcttgtgcatcagtggttttgattgctgccatacacattcagaattgctgcagatagagttcgactacagaggatacaatggttccatacttgcactacatatctgattttgaaagtatattagtttcattgtgaagatagggattaagggattcggtttattctctgcttgttagttagatcttgtagttaaaaagatttgaggaaaagaaaggtagcgtttaactgcattcccagtcaaattctgcggattgcgatg

SEQ ID NO: 4406 - DNA, 729 bp, Triticum aestivum
aaggaaggggttcacattgcttccctatgccgcttggtcaagaatgacacgctcagcttcgagatcaatggcgaccctgggaaggaggatgaggctaaggccagtggccgtggcatggggcgcatccgccccacggccggcaagaagatgtccggcaaggtgcgcagcgtgcaggcatttgatttcgccgagtggctgaagcagacggtatcggagcaggactacgtggtgatgaagatggatgtggaggggactgagtttgacttgatcccgaggctcttcgacacgggcgcgatctgcttggtcgacgaggtgttcctcgagtgccattacaaccggtggcaaaggtgctgccctggcgagcggtcgcccaagtatcagaacacatacgaggagtgcctggagctcttcagctcgctccgggagagcggcgttcttgtgcatcagtggttttgattgctgccatacacattcagagttgctgcagatagggttcgactacagaggacaaaagggtttcatacttccagtacatgtttgatttccaaagtatattagtttcattgtgaagatagatagagattaagggatttggtctattctctgttggttagttagttagaccttgtagttaaaagaagatttgaggaaaaagaaaggaagcgtttaactgcattcccagtaaaattctgcggattgctattgttactgttattgagcaaaggaatt

SEQ ID NO: 4407 - DNA, 815 bp, Triticum aestivum
  misc_feature (625)..(645): n = any nucleotide
gagattctacacctctcagattgctgctgccgagatgtctaacccatctgctgcaactgggcagcgaggcaatactggtaagctgtctaaccttggggacagcgccaggaaacagtatttaagagagcatcggtcgagttcaagatacagccaactcgctgctgccgaccagtctgacaaacccaaatggtcgcaatcgcatcaattccaagaaagaccgtcatcttcccatcggaaggatgaagtggtggcagataaggagcctacaggggtgaatggcacgaggaagaaccgaatccagtactcaggaccattgatgcctcccggggtaaacatggaggagatccttaaagagcacgagcggcagatccaacaagccgtgcgaagggctcgtctggacaagggaaagggcaagcacgccgagagagaccagtcggagtcgctgctctacgctgcccataatggcaggtcatagcgccgcgaagctcggctcggtgttgttgatggcttcggcaatggaaagtagtgtatgatccccttattttttacgcccccgtcgagcggagaggtttgttctgccggcagctcccacaccattgcgccagtggactggtggttcctggcnnnnnnnnnnnnnnnnnnnnngcctgctcttgctcatgtagagattttcgccaagtttagcaagatattcgctggaaaaatttgttgcccacacagtcaccaattgtatatctcagagatgagtacccaccctcttttgaggattgatgattcttacacctgtgttttggtaggtgccaagagaaatataa

SEQ ID NO: 4408 - DNA, 723 bp, Triticum aestivum
tggggacagcgccaggatacagtatttaagagagcatcggtcgagttcaagatacagtcaactcgctgctgccgaccagtctgacaaacccaaatgggtcgcaatcgcatcaattccaagaaagaccgtcatcttcccatcggaaggatgaagtggtggcagataaggagcctacaggggtgaatggcacgaggaagaaccgaatccagtactcaggaccattgatgcctcctggggtaaacatggaagagatccttaaagagcacgagcggcaaatccagcaagccgtgcgaagggctcgtctggacaagggaaagggcaagcacgccgagagagaccagtcagagtcgctgctgtacgctgcccataatggcaggtcatagcgccgcaaagctcggctcggcattcttgatggcttcggcaatggaaagtagtgtatgatccccttattttttacgcccccgtcgagcggagaggtttgttctgccggcagctcccacaccattgcgccagtggactggtagttcctggcagcaagaagaagaagaaggcctgctcttcactcatgtagagattttcgccaagtttagcaagaaagatattcgctggaaaaatttgttgcccacacagtcaccaattgtatatctcagagatgagtacccaccctcttgaggattgatgattcttacacctgtgttttggtaggtgccaagagaaatataa

SEQ ID NO: 4409 - DNA, 671 bp, Triticum aestivum
gcggcctcatggactacgccttccagttcatccacaagaacgggatcaccaccgagtccaactacccgtatcaaggcgagcagggcagctgcgacctggcaaaggaaaaggctcatgccgtgacaatcgacggctacgaggatgtccccgccaacgatgagtctgccctacagaaagccgtcgcaggccagcccgtgtccgttgcaatagatgccagcggcaacgacttccagttctactcagagggcgtcttcactggagaatgcagcacggatctcgaccacggtgtcgccgccgtcgggtacggcactactcgggatggcaccaaatactggatcgtgaagaactcgtggggagaggactggggtgagaagggctacatcaggatgcagcgcggggtgtcgcaggcagaggggcagtgtggcatcgccatgcaggcgtcgtacccaactaagtcggcaccacgtgctagggcagtcagggaagggtctcatactgatgagctctgatggcacacatacgatcattcggagtgcaacctctgcgttgaggagaactgaatctcccactgttgtgttatttactttatgcaagatgttactatgaatgtaataaacgtaggcaaaggacattatagcaaaagaattgcaactaatttgtcaaatcaaatg

SEQ ID NO: 4410 - DNA, 776 bp, Triticum aestivum
ccaatcttgaatttcattgaatcatttgacaaattagttgggattctttgctataatgccctttgcttacgcttattacattcgtatggtaacatcttgcataaagtaaataacacaacagtgggagattcagttctcctcaacgcagagctcgcactcggaatgatcgcatgtatgcatgtcatctagagctcatccgtatgagacccgtccctgactgtgctagcatgtggtgccgacttcgttgggtaggacgcctgcatggcgatgccacactgcccctctgcctgcgacaccccgcgctgcatcctgatgtagcctttctcaccccagtcctctccccacgagttcttgacgatccagtatttggtgccatccctggtagtgccgtacccgacggcggcgacgccgtggtcgagatccgtgctgcattctccggtgaagacgccctctgagtagaactggaagtcgttgccgctggcgtctattgccacggacacgggctggccggcgacggctttctgtagagcggactcgtcgttggcggggacgtcctcgtagccgtcgatcgtcacggcatgagccttttcctttgcctggtcgcagctgccctgctcgccttggtacgggtagttggactcggtggtgatcccgttcttgtggatgaactggaaggcgtagtccatgaggccgccgtcgcagccctggttgttgacgttgtcgcagtccatgagctcctgctccgacagcgacacagcttcccgtcctgatcttgt

SEQ ID NO: 4411 - DNA, 775 bp, Triticum aestivum
agatcagcacggggaagctgtgtcgctgtcggagcaggagctcatggactgtgacaacgtcaacaaccagggctgcgacggcggcctcatggactacgccttcctagttcatccacaagaatgggatcaccaccgagtccaactacccgtaccaaggcgagcagggcagctgcgaccaggcaaaggaaaaggctcataacgtgacgatcgacggctacgaggatgtccccgccaacgacgagtctgccctacagaaagccgtcgctggccagcccgtgtccgtggcaatagacgccagcggcaacgacttccagttctactcagagggcgtcttcaccggagaatgcagcacggatctcgaccacggcgtcgccgccgtcgggtacggcactaccagggatggcaccaagtactggatcgtcaagaactcgtggggagaggactggggcgagaagggctacatcaggatgcagcgcggggtgtcgcagccagaggggcagtgtggcatcgccatgcaggcgtcctacccaactaagtcggcaccacatgccaggacggtcagggaagggtctcatagtgatgagctctagatggcatgcacacatatgatcattcggagtgcaagctctgcgttgaggagaactgaatctcccactgttgtgttatttactttatgcaagatgttaccacaaatgtaataaacgtaagcaaggacattatagcaaagaattgcaactaatttgtcaaatcaaatggattaagtgcaattcaagac

SEQ ID NO: 4412 - DNA, 652 bp, Triticum aestivum
  misc_feature (102)..(102): n = any nucleotide
caccttgtgagctgcgtcactgccaggctctttgtgcgattgggaaagcgaaatgctcccgtccaaggacaccaggcagctcctgctggatgtgtgctgcgncctctcatggatgactacaactggctgcagcatgttgcaggtcgtttgaccggtctgtcgttgaggaagggatcgggtcgacgatcctgacgctgccgctggaggatcagcagacgatactgctctcatggctcgggagcttcctgaaggttggtaacagctgccccaacctgcagaaggcctttgaggtgtggtggaggaggacctttgtgcggccttacgtcgaacagcaggggagccgttcgcagtcgggtcggagctgagatctccggcggcttgcgcagggaagctaccgcgcgccgtttcgtaagtagaacatcgctgaaaatggtttagtggtataagttgatttgtgtgaggcttgaaatatgtttgtgcgctgtgctagtgatgcttcttcggttcttcgctgatacgtgaagctctctgaattctggcttacagaatgtcttgtctgatgtggtgctcacttaccacgagacatcagtttgttgcattgtgttttgttactacgacttgtgcggtattattgcggctcacatgtagaaac

SEQ ID NO: 4413 - DNA, 697 bp, Triticum aestivum
ctaccgaccaattcgcgccaccttgtgagctgcgtcactgccaggctctttgtggcgattgggaaaggcgaatgctcccgtccaaggacaccaggcagctcctcctggatgtctggctgcagcctctcatggatgactacaactggctgcagcacggttgcaggtcgttcgaccggaccgtcgtcgaggaagggatcgggtcgaccatcctgacgctgccgctggaggatcagcagacgatactgctctcgtggctcgggagcttcctcaaggttgggaacagctgccccaacctgcagaaggcctttgaggtgtggtggaggaggacctttgtgcggccttacgtcgaacagcaggggagccggtcgcagtcgtgtcggagttgagatctccggtggcttgcgcagtgaagctatcgcgcgccgtttcgtaagtagaacatcgctgaaaaagggtttagtcgtataagttgatttgtgtgaggcttgagaatatgtttgtgcgctgtgctttgtggtgcttcttcgggtcttcgctgatacgtcaagttctctgaattctggcttaccgaatgtcttgtctgatgtgctgcttatttaccaacgagacatcagtttgttgacaattgcgatatgataccacagacaattgatgacggataagatggtgacactgtaaaaatgcggctcaccagata

SEQ ID NO: 4414 - DNA, 657 bp, Triticum aestivum
ggacaccagcagctcctcctggatgtctgtctgcagcctctcatggatgactacaactggctgcagcacggttgcaggtcgttcgaccggaccgtcgtcgaggaagggatcgggtcgacgatcctgacgctgccgctggaggatcagcagacgatactgctctcgtggctcgggagtttcctcaaggtcggtaacagctgccccaacctgcagaaggcctttgaggtgtggtggaggaggacctttgtgcggccttacgtcgaacagcagggaagccggtcgcagtcgggtcggagctgagatctccggtggcggcttgcgcagggaggctatcgcgggcgccgattcgtaagtagaacatcgctgaagaagatttagtctataagttgatttgtgtgaggctttgagatatgtttgtgcgctgtgctttgtgatgcttcttcggttcttcgctgacacgtgaagttccctgaattctggcctaccgaatgtcttgtctgatgtgctgcttacttaccacgggacatcagtttgttgcattgtgttttgttactacgacattgtgcggtattggtgacactgtattattgcggctcacatgtagaaactgaatgcttgtgatgcaactgtaaatattttgctgggatgtaggaatac

SEQ ID NO: 4415 - DNA, 455 bp, Triticum aestivum
  misc_feature (146)..(146): n = any nucleotide
  misc_feature (249)..(249): n = any nucleotide
ttccccccagactacccattcaaaccaccgaaggttgcatttaaaacaaaggttttccacccaaatatcaatgggagcatctgccttgatatcttgaaggaacaatggagccctgcattgacagtttcaaaggtgctcctttcaanctgctctctactaacagacccgaaccccgacgacccgttggttccggagattgcacacatgtacaagagtgatcgtgcgaagtatgagtccacagcgaggagntggacccagaagtatgcaatgggctgaccttgtgagcctaggtggaggatgatgttggagccatcttcgcttgttacacctaatgtatctttgttcctgttctgctgctgctatatgggattgtactgtccacctacctgactgaattcaagtgtcatattgtgaagtgatggcagaaggcctctatgggtctatggtgcacccaa

SEQ ID NO: 4416 - DNA, 583 bp, Triticum aestivum
tacttccatgtgtgaaaggtgactaggagaggtttcatgttatttttctgttccatgctagcacatgtagataaaatatttgtgctatagcatgatctaagtagttgcaactgctttgccaatgtctttcaacatttcaggtaaatctgaaatgcttgtcttgagctccgcatttcctctagctaaattatgatggaaacaattttccagtttgcatttaaaacaaaggttttccacccaaatatcaacagcaatgggagcatctgtcttgatatcttgaaggagcaatggagccctgcattgacagtttcaaaggtgctcctttcaatctgctctctactaacggacccaaaccctgacgacccgttggttccggagattgcacacatgtacaagagcgaccgtgcaaagtatgagtccacagcgaggagctggacccagaagtatgcaatgggctgaccctggtagccgcgggtggaggatgatgttggagccatcttcgcttgtaacacctaatgtatctttgttcctgttctgctgctgctatatgggattgtactgtccacctgactgaattcaagtg

SEQ ID NO: 4417 - DNA, 729 bp, Triticum aestivum
tccctctcgattccgatcggaatcgcaactagctccgccgcttgattagccggcagccccgtccccatggcgtccaagcggatcctcaaggagctcaaggacctgcagagggatccccccacctcctgcagcgccggccctgtggcggaagatatgttccactggcaagcgacgatcatgggtccatcggaaagcccatatgctggtggtgtatttttggttactattcacttccccccagactacccattcaagccacccaaggttgcatttaaaacaaaggttttccacccaaatatcaacagcaatgggagcatctgtcttgatatcttgaaggagcaatggagccctgcattgacagtttcaaaggtgctcctttcaatctgctctctactaacggacccaaaccccgacgacccgttggttccggagattgcacacatgtacaagagcgaccgtgcgaagtatgagtccacagcgaggagctggacccagaagtatgcaatgggctgaccctggagccgcgcttggaggatgatgttggggccatcttcgcttgttacacctaatgtatctttgttcctgttctgctgctgctatatgggattgtactgtccacctacctgactgaattcaagtgtcatattgtgaagtgatggcagaaggcctctatgggtctatgggtgcacccatccaacaaattaatagagatgggaaccgaaactaaag

SEQ ID NO: 4418 - DNA, 735 bp, Triticum aestivum
ccgatcgaatcgcaactagccccgccgctgattagccggcagccggccccgtccccatggcgtccaagcggatcctcaaggagctcaaggacctgcagagggatccccccacctcctgcagcgccggccctgtggcggaagatatgttccactggcaggcgacaatcatgggtccatcggaaagcccatatgctggtggtgtatttttggttactattcacttccccccagactacccattcaagccacccaaggttgcatttaaaacaaaggttttccacccaaatatcaacagcaatgggagcatctgtcttgatatcttgaaggagcaatggagccctgcattgacagtttcaaaggtgctcctttcaatctgctctctactaacggacccaaaccctgacgacccgttggttccggagattgcacacatgtacaagagcgaccgtgcaaagtatgagtccacagcgaggagctggacccagaagtatgcaatgggctgaccctggtagccgcgggtggaggatgatgttggagccatcttcgcttgtaacacctaatgtatctttgttcctgttctgctgctgctatatgggattgtactgtccacctgactgaattcaagtgtcatattgtgaagtgatggcaaaaggcctctaatgggtctatgggtgcacccattcaacaaattaatagagatgggaactgaaactaaagttgttccgttgcttgaaa

SEQ ID NO: 4419 - DNA, 750 bp, Triticum aestivum
cctccctcctcttcgattttcgattggaatcggagccagctccgctgcctgattagccggccggccccggccccgtctccgtccccatggcgtccaagcggatcctcaaggagctcaaggacctgcagagggatccccccacctcctgcagcgccggccctgtggcagaagatatgttccactggcaagcaacgatcatgggcccatcggaaagcccatatgctggtggtgtatttttggttactattcacttccccccagactacccattcaaaccaccgaaggttgcatttaaaacaaaggttttccacccaaatatcaacagcaatgggagcatctgccttgatatcttgaaggaacaatggagccctgcattgacagtttcaaaggtgctcctttcaatctgctctctactaacagacccgaaccccgacgacccgttggttccggagattgcacacatgtacaagagtgatcgtgcgaagtatgagtccacagcgaggagctggacccagaagtatgcaatgggctgaccttgtgagcctaggtggaggatgatgttggagccatcttcgcttgttacacctaatgtatctttgttcctgttctgctgctgctatatgggattgtactgtccacctacctgactgaattcaagtgtcatattgtgaagtgatggcagaaggcctctatgggtctatgggtgcacccatccaacaaattaatagagatggaactgaaactaaattg

SEQ ID NO: 4420 - DNA, 902 bp, Triticum aestivum
gtgcaggtagatgatcaagtaactgttacccggtggtccaagcgacatgtaacacgaggctctgataagcgatcaacaaatattgttgaatggaggaagaagactacagaggcccgggctccatcttttgatgaaaaagaaagagaaagatgcatatcaaagtgcaagagagaggaagcaaagatcactgcttgggacaatctgcagaaagcaaaagcagaggcagcaattcggaagttggagatgaagcttgaaaagaagaggtcatcatcgatggatagaattttgggcaaactacgttctgctcaaaagaaagcacaaggcatgcgcactacagtttctgtcagtgaggatcagtgtgctgtcagtgaagatcagtgtgctgtgagggcaaccaagaaggcatccttgagaaggactagcaagcctttcagctgctgtttcacctatcatgcttgctagttgtgatatggttggtatctacaatgattgtagaaactttttttgaacctttgcagctcaagtcagccggcagacaaactgaagttagactgcaaatgtccgccgttgcagctggagatagcaggagtaattagaagaagagagcttagcgcggtctgatgaatcaaagttttggagcaaagcccactcttgtagctgatgatatggagtacttcactcggtactctgtatctgtaaaccaagcaagtgctgtagatcaggaagctcccttctcgagcttttctctagttgaactccggactgatgggccggtcctcatgggctgcctgatgctgtgtactgtatctttgccatggaattctgtatgtagtttcaagcattggggctccagtgtcaaatattggattcattgaacaaagttgtgagagccacaagctaga

SEQ ID NO: 4421 - DNA, 777 bp, Triticum aestivum
ccgggctccatcttttgatgaaaaagaaagagaaagatgcatatcaaagtgcaagagagaggaagcaaagatcactgcttgggaaaatctgcagaaagcaaaagcagaggcagcaatccggaagttggagatgaagcttgaaaagaagaggtcatcatcgatggacagaattttgggcaaactacgttctgctcaaaagaaagcacaaggcatgcgcactacagtttctgtcagcgaggatcagtgtgctgtcagtgaagatcagtgtgctgtgagggcaaccaagaaggcatccttgagaaggactggcaagcctttcagctgctgtttcacctaccatgcttgctagttctgatatggttggtatctacattgattgtagaaactttttgaacctttgcagctcaagtcagccgacagacaaaccgaagctggactgcaaatgtccgccgttgcagctggaggtagcaggagtagatagaagaagagagctttgcgcagtctgaagaatggaacactcaactggggtgtcagaaaatcgaagttttcgagcaaagcccactcttgtagccggtgatatgatatggagtacttgactcggtgctctgtatctgtaaaccaagcaagtgctgtaggtcaggaagctcccctctcgagcttctctctagttgaactccggactgatcggcctgatgatgtgtaatgtatctttcccgtggaattctgtatgtagtttcaagcattggggctccagtgtcaaatattggactcattaaa

SEQ ID NO: 4422 - DNA, 647 bp, Triticum aestivum
taagggatcctgaagtcatgacatcatacagggaactgtcaaagaaagcacagaaagcttactacatctggtggagactgagcggattgcttggtgacaagaatcgtccgttgatgtacatactgcttcaggcactgttcacagtggcgacattggctttcactgtacccatattcctttcataccgactgcatgggatcttccaagtactaaaggtgtgtgctgcaacatggaacggtggaagcttcatcctggaggtgatgcccagacaagttgtccagaaggagaagaagagacttgagatgaagcccattgaacaggcaaacttgaaggagcacatggatgatccttcaggtaaccaccagcatgcatccgaagagccaagtcagtgaggaaactgatttggggcgcaagattagattttctggttactggtactatcgtgtgaccttgttccttctgtaagaaaagttgctatcgatgaatgttctgttggcttgggacatttcagggctgtttatggtgggatcgctagttagggtgtgtgggcatgtttgacatagcaaagggtggtggttcaaatgctatcagcgcattttatgccaactttgtctctagggttttcaatgtgtgatgagtgtgctgag

SEQ ID NO: 4423 - DNA, 802 bp, Triticum aestivum
tgtgaaccctgccgtcaccttcggcctcgccctcggcggccagatcaccatcctcaccggcatcttctactgggttgccccagctcctcgggcgccatcgtcggcgcctttcctcgtccagttctgcaccggcgtggcgacccctacacacgggctttccggcgtgggcgccttcgagggcgtcgtgatggagatcatcgtcaccttcgggctcgtctacaccgtgtacgccaccgccgccgaccccaagaaggggtccctcggcaccatcgctccaatcgccatcggcttcatcgtcggcgccaacatcctcgtcgccggccccttctccggcgggtccatgaaccctgcacgctccttcggccccgccgttgccagcggcgacttcaccaacatctggatctactgggccggcccgctcatcggcggtggcctcgccggcgtcgtctaccggtacctgtacatgtgcgacgaccacaccgccgtcgccggcaacgactactaagccagccatgggaagatcattcggtctttggtttccataatgtcttcggcaacataagaagtgcgtacgtggtggtcactctcaggattgtctggatgatgtgaggaacgtcatgttgtttggttccgatcgaaagcccgcgaggctgtggcacttggatgatgcatgtttctgtatctgtactgtgatggatgttgtgaagttgttggggtttcaagattcttcagttgagtttccttatgcgattcaataagagcatcattgtttagtgcattcccatgcccactggccaaactt

SEQ ID NO: 4424 - DNA, 613 bp, Triticum aestivum
aacgacgacactaatacggactgtttcctttctcaggccacccctacacacgggctttccggcgtggcgcctttgagggcgtcgtgatggagatcatcgtcaccttcgggctcgtctacaccgtgtacgccaccgccgccgaccccaagaagggatccctcggcaccatcgcccccatcgccatcggcttcatcgtcggcgccaacatcctcgtggccggccccttctccggcgggtccatgaaccctgcacgctccttcggccccgccgttgccagcggcgacttcaccaacatctgggtctactgggccggcccgctcatcggcggtggcctcgccggcgtcgtctaccgatacctatacatgtgcgacgaccacagccccgtcgccggcaacgactactaagccagccatgggaagagtcgttcggtccataatgccttcggcaacataaaaagtgcgtacgtggtgggcagtctcacgaatgtctcgatgatgtgaagaacatcctgttgtttggttcagatcgaagctgtagctggatgatgcatgttcctttatctgtaaaatgtgatgttgtgaagttggttgggtttgagaattcttcagttgag

SEQ ID NO: 4425 - DNA, 730 bp, Triticum aestivum
cgtcaccttcggcttcgccctcggcggccagatcaccatcctcaccggcatcttctattgggttgcccagctcctcggtgccatcgtcggcgccttcctcgtccagttctgcaccggcgtggcgacccctacacacgggctttccggcgtgggcgcctttgagggcgtcgtgatggagatcatcgtcaccttcgggctcgtctacaccgtgtacgccaccgccgccgaccccaagaagggttccctcggcaccatcgcccccatcgccatcggcttcatcgtcggcgccaacatcctcgttgccggccccttctccggcgggtccatgaaccctgcacgctccttcggccccgccgttgccagcggcgacttcaccaacatctggatctactgggccggcccgctcatcggcggtggcctcgccggcgtcgtctaccggtacgtgtacatgtgcgacgaccacagctccgtcgccggcaacgactactaagccagccatgggaagagtcgtcgggtccataatgccttcggcaacataaaagtgcgtacgtggtgggcagtctcacgaatgtctcgatgatgtgaagaacatcctgttgtttggttcagatcgaagctgtagcacctggatgatgcatgttcctttatctgtaaaatgtgatgttgtgaagttggtggggtttgagaattcttcagttgagtttccttatgcgattcaataagaacatca

SEQ ID NO: 4426 - DNA, 705 bp, Triticum aestivum
  misc_feature (22)..(22): n = any nucleotide
tgttttcagtagtggccagtgnaaaggcagcgggttgcatggttactacagggaaagttgtggaaggctgcaatgttcgggttcttcgtaaaggaaaagaagtttatgtgggtacacttgattccttgagacgggtgaaagaaactgtgaaggaggttggtgcggggctagaatgtggtattggggtagatgacttcgacgattgggaggaaggtgacgtccttgaggcattcaacaccgtgaaaaaggctagaacgctcgaggaagcctctgcgactgtgactgctgctctcaagggtgcaggcgtccaggtgtagatgttgcaaagctgataagcgagtaacaactgcagcagccattttttctttcggcgtcgcagctggagtgcgttggccacattccctaagaatgacactcaggtagttgaaagacagaacctatacatgacacatgaagtgcttgcgttgctgccgggagcctgcctgtgctggaccgtattgtatcccgcctctcaaagctgcatgtgctactgtatgttgatgtacatagagaagattacatctgctgtttttagtttgcctctaacaggtagataaagggggggtggggtgtttctagttttataccttttgtcttcttgagacaagctgtaacctgcaacgttgaggccgcatcattttccgatcatcattcgtcatcgtctac

SEQ ID NO: 4427 - DNA, 623 bp, Triticum aestivum
gaagctgctctcctacattgagcagcaggccacggctgctggcgctcgctgccggccaaggccgggctgcagcggtgcggcaagagctgccggctccggtggaccaactacctccggccggacatcaagaggggcaagttcagcctgcaggaggagcagaccatcatccagctccatgcgcttctcggcaacaggtggtcagcgatcgcgacgcacctgcccaagcgtaccgacaacgagatcaagaactactggaacacgcacctcaagaagcggctggccaagatgggcatcgacccggtcacgcacaagccgcgctccgacgtgcccggcggcgcgggcggcgccgccgagggggcggccggcgcgcagcacgccaaggccgcggcgcacctcagccacacggcgcagtgggagagcgcgcggctcgaggccgaggcgcgcctggcgcgggaggccaagctgcgggcgctcgccacgtccgcctcctcctcggcgcagtaccttgtcggcggcccacgccgccgcgcccgggctcgactcgcccacgtccacgctcagctttgcggacagcgcggcgctcgcgttcggtgctggaggcgcccagtgccgggggcgctcta

SEQ ID NO: 4428 - DNA, 681 bp, Triticum aestivum
  misc_feature (487)..(502): n = any nucleotide
acgggtgatgttctggcgcgcatgagggcgatctcccgctcgacgtccggcgggtagagcgactgcccggcgcgctgccggcgcttgaggcgcgtgttccagaagttcttgacctcgttgtccgtcctccccggcaggtgtgttgagatgcgcgcccacttgttgccgatgaggccgtggaggcggaggatgaggcgctcctcctcgggggagaaggggcccttgcggaggttggggcggaggtggttggcccaccggagccggcagctcttgccgcagcgctgcagcccggtctcccggcgcaccgcgttccagttgccctcgccgtgccgccgcacgtggtcgagcagcacccggtcctccgcctgcgtccacggccccttcttcagcccaccgccgccgccgccttcccccaccccgctcctcggcaccgtcgtgtccatcgccgtcgccatgtcagcagatcgtcttcgtctccccgcaccannnnnnnnnnnnnnnngtgctcgcgccgcgaggtgtcgtcggtccttctggtcttctctcctcccctcccggcccggacgtccaagagagaggggggagagagaactgcacgcgatgtcggtgtcggcgccggcttacctccagcgcatggcccggcgggccggatgaacgagcaggtcgagagctggaacgaat

SEQ ID NO: 4429 - DNA, 597 bp, Triticum aestivum
cagtcacttgtttatggtacaattttctacagcctgggttcgtttgagtggacagcagtgaagttcttgtggttcctgttcttcatgtacttcactctgttgtacttcaccttttatggcatgatgacaacggcgatcacaccaaaccatatggtcgcgcctatcattgccgccccattctacacgctatggaatctcttctgcgggttcatgatcccaagaaagctgatcccagtgtggtggaggtggtactactgggccaacccggtgtcctggacgctgtacgggctcctgacctcccagttcggcgacctggaccagcccctgctgctggccgacggcatcagaaccaccaccgtcgtggcgttcctggaggagcactttgggttccggcacgacttcctcggcgtagtcgccacgatggtgatcggcttctgcgtcctcttcgccgtcgtcttcgccctcgccatcaggaacctcaacttccagcgcagatgatcggcagcagcaaatgtaccccgcgcagtttaacttaattacccagcatgcatgtgttcaatcaattaagagctcgtaaataatttcgagagagacatc

SEQ ID NO: 4430 - DNA, 597 bp, Triticum aestivum
tgatgaagagaaagaaaagtggatgaattggactacttaactggaattccagtggcaagtgacattttgctatacgcagtacctgtatgtgcaccttataacgcgctacagacatacaaatatcgtgtaaagatcaccccaggcactgcaaagaaaggaaaagccgccaaaactgctatgagcttattcatgcacattcctgatgccacgaaccgcgagaaggaactaatgaaggcatgcactgatcctgaattggttgctgcgattgttggaaatgccaaaatcaccgcacctggcctcactcaactgaagcagaagcagaagcagaaagggaaaaaggctgcgaaaagtaactagattgaaaccaccatgacaatgcactgacgttttgatccactgctgtctgcagaacgcatgtaaatcctgtggtatgatctgtctgcactctgtagaaatcatgtaaatcacgtgatgtgatcagttgaggcagcaaatagtacactttagtgtatgtaaagtattctacacctctggcatttgagaggccaggggccagtgcaacagagacggcggcctaaaagagcaaatatacactct

SEQ ID NO: 4431 - DNA, 598 bp, Triticum aestivum
aggagatgttcaagaccatggacacggacggcagcggtgccatcacgttcgaggagctcagggaggggctacgccgttacgggtccaccgagctcagggactcagaggtgcgggacctgatggaggccgccgacgtggaccgcagcggcaccatcgattacgacgagttcatcgccgcgaccgtgcacatgaacaagctggaccgtgaggagcacctcatggcggccttctcctacttcgacaaggacggcagcgggtacatcaccgtcgatgagctggaggtggcgtgtcgcgagcacaacatggccgacgtcggcatcgacgacatcatcagggaggtcgaccaggacaacgatggtcggatcgactacggggagttcgtggccatgatgaagaaggggatcatcggcaatggcaggcttaccatgaggcacacctccgacggcagcatcctccatggagcaggcagcggcctcagcagctagccagctaacaagcatagctccaccagccatccattgatcaatcgatcgccatggttgtgccaactacattgtatttgaatttaatagaagatgagcaagaatacgacgcgggt

SEQ ID NO: 4432 - DNA, 976 bp, Triticum aestivum
gattgtaatctacgatcagtgctgacaattgcctttcaattcccttacgagatgcatctccaagatagtgttgcaactatggcccggcagtatgtccgcagcattgtctccgccgttcagagagtgtcgatggctatctctccctctcgatctggcttgaatgctgaacataagataatttctggcttccctgaagctgcaacactagctcgctggatatgccaaagttaccggttccatctgggggtcgagttatttagacaggcagatgaagctggggaatctttattgagaatgctttgggatcatgaagatgctattttgtgctgttctttcaaggaaaagcctgtatttacgtttgcaaacgagatgggaattaacatgttggaaacatctttcgttgcccttcaagatctctcgttggacaagatatttgatgaagctggtagaaaggcactatactccgagatcccaaagttgatggagcagggctttgtttacctgccaggtggtgtgtgcttgtctgggatgggccgccatgtctcatttgagaatgctgtagcatggaaagtagttggtgaggacaacaacgtgcactgcctcgccttctgcttcgtcaactggtctttcgtgtgatcatccatcacctgtccccgtcgcatgcagctccatttttgctctctgtaggagagaaccgccgccactggaaagtagttttacgctatctttaactagtttgtttctagatttgaagagccagcatcgggaagaattctgcctcgtgtaaaatctgctcacgtttccactaatttacccaggcaagaagctggctgatgtctgtctggattgaggtgctagcctttcttgaatctagaaaggttcctacttttattcgtgtgatgatgatggaatgctagtagtagcgaaattgggacacagctgatgtataatcagtgtttgtgtgcctttttcgctt

SEQ ID NO: 4433 - DNA, 1054 bp, Triticum aestivum
gcttttggtttacgagtatatgccgctaggttctttggaagaccaccttgcacgatccttccccagataaaccccgccttgactggaatacacggatgaagatagctgccggtgcagctaaagggctggagcatttgcatgacaaaacaaatcctcctgtcatataccgggacttgaaatgttcaaacatcttgctcggagagggataccacccaaaactgtctgactttggattggcaaagcttggcccagttggcgataagacacacgtttccaccagagtgatgggtacatacgggtattgtgcgcctgagtatgctatgaccggtcagctgactctgaagtcggatgtttacagctatggtgttgttctattggagatcatcacagggcgaagggctatcgacaacactcgagctgcgggggagcaaaaccttgttgcatgggcccgtcccttgttcaaggacaggaggaagttcccccaaatggcagacccggcgctggagggccggtacccggcaaggggactgtaccaggccctggccgtcgccgcaatgtgcgtgcaagaacagccaaccctgaggccgttgatcggcgacgtcgtcacagccctgagctaccttgcctcccagccctacgatccggaggtgcacggcgtccaccgcccgtcgcgcctgacggcttccggcacgccgccccgagcccggaaccacggtgccgatcatcaaagaggaggaagcgagtgaggcggtgcggcttccggagagccctgaattttgtcgcggtacgagtccaaaatggagctgaagaggaattttgtggatagcgaggcggcttttgcgtttacatgttgggggggaattgtgaatcggtgatgtatgttgatcggttggtctatctggttgagatggtgccagagatgatgcatgcatgtgctctccggttagagtatgtatctaggtagatgacgaggcagtcggtgtaaccacccatgactttacagttcgatcagtctatggactaccatttctccttgtatttgacagaactgcta

SEQ ID NO: 4434 - DNA, 1057 bp, Triticum aestivum
gagacgtgactgcaaccttggttcctgtccgcacccagctgccacaggcttgtctgcaccggtacgctctctcgctggtacgcgatttgaggcataggagcgaggggcacgttgcaaggtcgtcttcggtcacggctacaacttatgacgagaaggggatatatgcttagtaggctgccctgtggttagcaagtcattgtcgcagtctccgcctcccaggttgcctcggcttgctgttggtgtgtgttgctgcaacagccccttccggccacctctgaggttgggcaatgtggccactgatgtcaagggcgtcgccatcttacttgcaaggcacaaattgcaccgcacgcaacatcttgctatgcatggccactgatgccaaagagaaccaagtgccttgacgtactatataaagagatcatgtgaaaacaaagctgaagttcttgatcaggatgagaaggaaagtggtcttcgagcaacactaatcctgggtcatacatttggtcatgctatagaaacagggcttggctatggagaatggctccatggggaagctgttgctgctggaacggttatggcagctgacatgtcttaccgcctgggctggatagacgagtccatcaagaaacggacatttgacatactagatcaagccaagcttcccgtgacaccaccaaagggcatgacggtggagaagttcaagaacatcatggctgtcgacaagaaggtcgcggacggattgctgaggctcatccttctgaaaggacctctgggaggctgcgttttcaccggcgagtacgacaggaaagccctagacgaaaccctccgcgcgttctgcgacaattgatcctgtatactagtaggctgtaatgtcatatcagacagagagagtgagtgcatcgtatgctacctttattttttcatttcgttttggcgagaataatagaatgcggtgaggggttggttccaggtcgtagtagcaattcattgtagggcatcatacctcagtaattgtgaattgtggtctagtcattttgaaaaaccaaaaatcacccaa

SEQ ID NO: 4435 - DNA, 628 bp, Triticum aestivum
atgagaaagaaagtgtcttcgagcaacactaaacctgggtcatacatttggtcatgctatagaaacagggcttggctatggagaatggctccatggggaagccgttgctgctggaacggttatggcagctgacatgtcttaccgcctgggctggatagacgagtccatcaagaaacggacatttgacatactagatcaagccaagcttcccgtgacaccaccaaagggcatgacggtggagaagttcaaaaacatcatggctgtcgacaagaaggtcgcggacggattgctgaggctcatccttctgaaaggacctctgggaggctgcgttttcaccggtgagtacgacaggaaagcactggacgaaaccctccgtgcgttctgcgacaactgatcgttgtcaagctggagacccagcacttctgtatactagtaggctgtaatatcataccagacagagagagtgagagtgcattgtgtgctacctttattttttcatttcgttttggcgagaataatggaatgcggtaaggggttggttccaggtcgcggtattagaaattcattgtagggcatcatgcctcagtaattgtgaattgtgatcactcattttgaataacagaattca

SEQ ID NO: 4436 - DNA, 504 bp, Triticum aestivum
gacctacgctataaagagatcatgtgaaaacaaagctgaagtttttgctcaggatgagaaggaaatggtcttcgagcacactaaacctgggtcatacatttggtcatgctatagaaacagggcttggctatggagaatggctccacggggaggctgttgctgctggaacggttatggcagctgacatgtcttaccgcctgggctggatagacgagtccatcaagaaacggacatttgacatactagatcaagccaagcttcccgtgacatcaccaaagggcatgacggtagagaagttcagaaacatcatggcggtcgacaagaaggtcgcggacggattgttgaggctcatccttctgaaaggacctctgggaggctgcgttttcaccggcgagtacgacaggaaagccctggacgaaaccctccgcgctttctgcgacaactgatcgttgtcaagctggagctccagcatttctgtatactagtaggctgtaatatcatatc

SEQ ID NO: 4437 - DNA, 716 bp, Triticum aestivum
  misc_feature (617)..(617): n = any nucleotide
  misc_feature (693)..(693): n = any nucleotide
  misc_feature (697)..(697): n = any nucleotide
cactcccccagatggagtcaagaaggccatggagatgcaggccgcagcagagcgcaagaaacgtgctcagatcctcgagtctgataggtgctatgatggaaaatgcaaacaaagcaaagggtgaagctgaagcgattcttgccaggtcgcaagccactgctgaagggatcaggatggtctcggagtcgtttaaaactgaaggcagcacagaggctgccagcttgaggattgctgaacagtacatcagagcattcagtgaactggctagaagtacgaacacgatgcttcttcccagcgacgcaggcaatccggggacaatgattgctcaggcgctccagatatacaaccacacgtacaagcagaaactgacgctgggaagccccggccccagcaagcgggcagaagaggctgatttgtcccttgggatgccatccgtgagcgacctcggcacctttgagcaccacaagtagagtattgactattgagtggggaatcttctctttttttctttttctcttctgttagggaggagaggaatgaatagctagactggatagatagattgctagggaggcagcgcaactttgtcacgagtgaagatttactgattaggtcgntcggtcggttggataaaacacaatactctgttcctgttggttaggagcagctttgagagaaagctttttatctgtntatntgaattgagtggtgaacct

SEQ ID NO: 4438 - DNA, 1058 bp, Triticum aestivum
cttctccatggcaagaagggcgaacacctgcactgggacactcggtacaagattgcaattgaagctgccaaggggctgtgctacctgcaccatgattgttcaccgctgatacttcaccgtgatgtcaagtcaaacaatatacttcttgactctgactttgaagctcatgtggccgacttcgggctggcgaaattcctgcaggacaccggcgcatcagaatgcatgtccgccattgctggttcatatggctacattgctccagaatatgcatacaccctcaaggtcgatgagaagagcgacgtctacagcttcggcgtggtgcttctggagctcgtcaccgggcgtaaacctgtgggggagtttggcgacggcgtcgacattgtccagtgggtcaagatgatgacaggcccaaacaaggagcaagtgatgaagatcctggacccgaggctgtcgaccgtgccggtgcacgaggtcatgcacgtattctacgtccctgctgtgcaccgaggagcacagcgtgcagcgcccgacgatgcgggaggtcgtgcagatcctgagcgagctcccaaagccagctgccaaccaagatggagaagaagagcttcctctctcctgcgaaggacctgaatccaaccctcttgccccaaccagttacaccgaggcaccagccggcgacgcgaaagatcagcagccgcagaagcagcacacaagctcggagtcgtcgcctcctcctgatctcatcagcatctgatcatccaagtacccggaagcatcgccgtccgtcgcaaatatgttggggcttcctttgatcgtgcaagcttaggcctgaatctggggttcgttgggtgagagactttgttggtgttgtgctgtacatatccaagctgctttggtggtgggggtgtccaagagcttccagtttggtgtgtgtttgcctgtttggtactttgctttgctgcttgtagccgtagggattatgtggtagtggagcctttgatgatctttccttgtgcaatgtagtagtagtatctagtagataagccatctagctaagttca

SEQ ID NO: 4439 - DNA, 961 bp, Triticum aestivum
  misc_feature (743)..(765): n = any nucleotide
cgttgagcgccgccgcgcgtgctcctccctgcccggacccctcctgcaacccgcatcgcctccagtgcctggcgcgacctcttcttcgaacgccaccgctcggcctgcttctgtcgacgccgccgcccgggtcttcctccagaccgccgcaccccagtgccccgcgggacctcctcctcgaacgccgccgccgcgcctgcgacgccacagctgctgacaccatcgcgggttctccctcgcgcccatatttccccgcccactctccgcgggcgccgcgacctctcttccagctcggtttcccgaactccacccaaccatggccccagaaaggagtgggtctaagaagcaggagctcaactctcagaaaaagctagagaagaagctcagcttctatacaaaagtgaaagatgcggttacctccctacaggccaaaaaggctatcagtaagaaaaagaaacagaggagccgtcagaagaaactgaaagcatatgatctgtcagcactttctgagttccttccacaaacagccagctcccagcagcagacggaagtaaagcttaaccgcaaatcgaagcaggctttagtgcagcgagagtctgctcaactgaatgctgtactgaacaatgctcagttccagctagacccattggctgcaattcatcagcatctggtatcaacacaaccgccttcttccgtgaaagacgacgaatctgcaaagaacgcgaagatatctaggaaggacnnnnnnnnnnnnnnnnnnnnnnnaaatgctttgtcgacccctcagtcgatggatatctgatactgcgaactaactgtctaaagtaatgaacgcagctacttttcttatcttggtctgtaggtgacccttgtcatctgtgaacttggaagttgtaaaattttgctaccagtgtgagttttgtgtgtctgaacttccagcttgcttttttctcgaaagaaa

SEQ ID NO: 4440 - DNA, 436 bp, Triticum aestivum
caccatggcctcagaaaggattggttctaagaaagcaggagctcaactctaagaaaaagctagagaagaagctcagctttctatacaaaagtgaaagatgcggttacctccctacaggccaaaaaggctatcagtaagaaaaagaaacagaggagccgtcagaagaaactgaaactgaaagcatatgatttgtcagcactttctgagttccttccacaaacagctggctcgcagcagcagacggaagtaaagctcaaccgcaagtcaaagcaggctttagtgcaacgagagtctgctcaactgaatgctgtactgaacaaccctcagttccagctagacccattggctgcaattcatcagcatctggtatcaacacaaccgccttcttccgtgaaagacgatgagtctgcaaagagcgggaagaaatctaggaagg

SEQ ID NO: 4441 - DNA, 606 bp, Triticum aestivum
cacgccggcgcgccatgatggcccgtcgctacggcagcatgtctccatcgccagcgtggccggcgtgctcggcggcgtcggcccgcacgcatacaccgcctccaagcacgccatcgtggggctcaccaagaacgccgcctgcgagctcggcgcgcacggcatccgcgtcaactgcgtctcgcccttcggcgtcgccaccccaatgctcatcaacgcgtggcgccagggccacgacgcgtcagccgccgacgacgccgacgccgacatcggcctggaggtggccgtgccgagcgaccaggaggtggagaagatggaggaggtggtgaggagcctcgccacgctcaaggggtcgacgctgaggcccagggacatcgccgaggcggtgctcttcctggccagcgacgactcgagatacgtgtccggccacaacctcgtggtggacggcggcgtcaccacctcaagaaacttgatcgggctgtgaaaaatcacatgacccacctcgcatctagcatctacgtagatcagtaggaggaacaaagatgattgtttagtctgcaataactgtactcaagttctttggttggttcgttcggttaattagttgat

SEQ ID NO: 4442 - DNA, 698 bp, Triticum aestivum
catcaactgcgactgctcgagtatcttcccttgacaagagaatcggttctgagtgagaagatcagcgtcggtacttcagtcggtaaacgataaagtaaaggaaatggatcagaaatatctagtctccgagaagacaaggtcagcacttgcagctgctgaacagggcgtctccactgctggatctgccatcatgaaaaacaggtatgtccttactggagctgcatgggtaactggtgccttcagtaaggttgcgaataccgcaaacgacgtcggggcaaaggcgaaggagaaaatagccgctgagcaggagggcaagaccgtagcggccgggtatgcacaagctgacatgtcggacgctcatgaaaagcccagggatttggatggtgaaatcacaaagatacatgtctctgaaaaccctgaagatatccccatatctaccgctgcagttttccccattacagtagaggattccagcgatgcgtctccaccaccgcccgctgctcctaagaaaccggaacctgcgcagggattgatactatgatgatctggctgatgcatgaatgtaaatagacatgagatgggttgtttaattcaggctgtagcgttgtggttgctgtattgtgattcacctgtttgaaggttgaaatttattgggaccgaaagagtttggaatttgtagcagccattttaattaatca

SEQ ID NO: 4443 - DNA, 956 bp, Triticum aestivum
ccatgcttctgacgggtgccacgatagtcgatatggctgtcatcgtaacaccagccactgattatgagctaccagctgatgttttagctgctctagagcccaaagatgcaaagtcctctgctcttgagaaggcagaggacatcgttgggaccatgctggccaaggggttcattcttggtagggatgcgctcgacaaagcaaaagctttagacgagaagcatcagctcacatcaactgcgactgctcgagtatcttcctttgacaagagaatcggtctgagtgagaagatcagcgttggtacttcagttgtaaatgataaagtaaaggaaatggatcagaaatatctagtttccgagaagactaggtcagcacttgcagctgctgaacagggcgtctctactgctggatctgccatcatgaagaacaggtatgtccttactggagcagcatgggtaactggtgccttcagtaaggttgcaaataccgcgaatgatgtcggggcaaaggcgaaggagaaaatagcggctgagcaggagggcaagaccgtagcggccgggcatgcacaagctgacatgtcggacgctcgtgaaaagcccagggatttggatggtgaagtcacaaagatacatgtctctgaaaaccctgaagatatccccatatctaccgctgcagttttccccattacagtagatgattccagcgatgcgtctccaccaccgcctgctactgctcttcccaagaaaccggaacctgcgcagggattgatactatgatgatctggctgatacatgaatgtaaatagacatatgaggtgggttgtttaattcaggctgtagcgttgtggctgctgtattgtgattcacctgtttgaaggttgaaatttatcaggaccgaaagagtttgggatttgtagcagccattttaattgatcaaacaatattatcatgcacttgcgt

SEQ ID NO: 4444 - DNA, 672 bp, Triticum aestivum
aatgtcagcaccgcggtcctcgagataaaagctgcccatcgccagggaggcgcactggtggaccagaacgtcccggtcccgctgagcatcctgtggcaaatccctcagtacttcctggtcggcgcctcggaggtgttcaccttcatcggggcgctcgagttcttctacgaccagtcgccggacgccatgaggagcctctgcagcgcgctgcagctcatcaccaccgcgctcgggaactacctcagcgccttcatcctcaccatggtcgcctacttcacgacgaggggagggagacccgggtggatccccgacaacctgaacgaggggcgcctcgataacttcttctggctgctcgcggggctcagctttctcaacttcttggtgtacgtgctgtgcgccaacaggttcaagagcaagaaagcggcttgagcttttgattgatggtcagaaaagttggacggcgtcggagcaacttgcttgaaaggtctaaaagacttgggaggtgtcatcctgtacatgtatacttcgaaatctgtatatatgttcctcagtacattatccctctgtttaagcacgtgtttacttttttaacaagctgtaattctctctgtattagaatccagtgtgggtcatggatctcctttcatgtacatatattttattcacttgaag

SEQ ID NO: 4445 - DNA, 942 bp, Triticum aestivum
  misc_feature (69)..(69): n = any nucleotide
cgtgcacatgatgaaagggcatgtgggccatcccggtgaacctgccgttcacggcgttcagccggagcntcaaggccagcggcagagcccgtcgggtgctggcggagatcacgcgggagaagacggccagccggtgccagccggagcacagcagggcgccgcggagcaacgacctcataacctgcctgctcggcctgacggacaaccatggcgagcggttgctgagcgacgaggagatcgtggacaacgccatggtcgccctcatcgccggccacgacacgtcgtccatcctgatgaccttcatggtccgccacctcgccaacgatgacgccaccctcgccgccatggtccaagagcatgaagagatcgccaggagcaaaggcgacggagaggctctcgcctgggaagatctgacgaggatgaagttcacatggcgagtcgcgcaggagatcctccgcatcgtccctccactcttcggcaacttcagaagagcgctggaggacgtggagttcgacggctacctcatcccaaaaggatggcaggtgttctggacgtcgaacgtgacgcacatggacgcgagcatcttccacgagccggccaagttcgacccgtccaggttcgagaaccaggcagcgccgccgtgctccttcgtcgccttcggggccggcccgaggctatgccccgggatagacttctcccggatcgagacgctggtgacgatgcaccacctggtgaggcggttcagatggaagctctgctgcaaggagaacaccttcgtgagggaccccatgccgtcgccgctgcgtggcctgcccatccaactcgagcacagggcctcccctcctccaccgtgaccaagcttcttcacagcaatctcactgtcatcgtcgttcgcattgcattagaaaaagtagcttgctgctgctgctgcaagtgtattgg

SEQ ID NO: 4446 - DNA, 894 bp, Triticum aestivum
  misc_feature (636)..(680): n = any nucleotide
gattccttagagcagcacatgcttctcaaaaagctccttgtgcaactttgggctatctgggcaattatcttgcggagttgacattgaccgattacagtttcctgaaatttcacccttcagtggtggcagcctcggcggtgttccttgcaaaatggacactcgaccaatcagacctgccatggaactctactctcgagcattacacctcatacaaaagttcagatattcaaggatgcgtacgcgatctatgggagctgcagcaaggcaacaccagcggaagtccccccctcaatgctatacgtgagaaataccggcaggaaaagtttgaatgtgtagccaacatgctgtcgccggcgatgcctgggtcgctcttccatagacaagctaacggcaccagccccctgctgatcaacaactcgtagcagcgcagcgtcagccccctgctgatcaacaatttgattttttccgaagatcttgtagcatccccttcccaccaccctctccccctccgatctggctgtgttgttatttccccccgacctttttcgagtcgtgcagtcgtaggcgatggctcacataaatgttgattgagttcctgcgtaggctgctgatggatgcctagggctggtaattgtnnnnnnnnnnnnnnnnnnnnnnnnnnnnnnnnnnnnnnnnnnnnnataactgagtgagttccgcttgatttaacgtaggtttgcgggcgtttcccagagtttagtgagtgcaattgcagtgcagtgctcgctcttgagattaggagagcaactctagtgagtccaggatggttgatgtgatctgatgtgatgtaacctgttgttacaagaacattcattattgcttggtttgtaaatgaacataaatgtagcctgactg

SEQ ID NO: 4447 - DNA, 872 bp, Triticum aestivum
aaaacgtttctgaggagattccttagagcagcacatgcttctcaaaaagctccttgtgcaactttgggctatctgggcaattatctcgcggagttgactttgaccgattacagtttcctgaaatttcacccttcagtggtggcagcctcggcagtgttccttgcaagatggacactcgaccaatcagacctgccatggaactgtactctcgagcattacacctcatacaaaagttctgatattcaaggatgcgtacgcgatctatgggagctgcagcagggcaacaccagcggaagtccccccctcaatgccatacgcgagaagtaccggcaggaaaagtttgaatgtgtagccaatatgctgtcgccggcgatgcctgtgtcgctcttccatagacaatctaacggcaccagccccctgctgatcaacaactcctagcagcgcagcgtcagccccctgctgatcaacaacctgatatttttcgaagatcttgtagcatccccttcccatcatcctctccccctccgatctggttgtgttgttatttccccccgacctttttcgagtcgtgcagtcgtaggcgatggctcacataaatgttgattgagttcctgtgtgggctgctgatggatgcctagggctggtaattgtatgatgatgatgatcctgtctgtctgtgtctgtatgataactgagtgagttccgcttgatttagcgtaggtttgagggcgtttcccagagtttagtgagtgcaattgcagtgcagtgctcgctcttgagattaggagagcaactgtagtgagtccaggatggttgatgtgatgtgatgtaacctgttgttacaagaacattcgttattgcttggtttgtaa

SEQ ID NO: 4448 - DNA, 532 bp, Triticum aestivum
ggtcttcaccgccgtcttacggggccttctacgtctccctcgaccgccgctccggcgcgctcgccgccctgctctgcctcctctgctgggccgccagctccgccctggccgcccgactcggcttctctgtcggatggaaggtggtattggtagctcagctgttctgttggactatgcaattcattggccatggagtttttgagaagcgggcacctgctctaattgacaatcttgtccaggctttgatgatggccccatatttcgtgcttctagagattctccacaagtttgctgcgtacgaaccatatcctggcttccatgccaatgctgcagaagctgattgacgccaaacgcaaggagtggccggacaagaaagcaaagaagatgtcctgagctgtgcccaagaacccctgatgcctgatgctacgtctgctgtgtaacagcgaagatgagaatgatctgccctgtttgtcgtctctatgttactgaagataaactgaactgtagactgatatcatcctgatacgtgata

SEQ ID NO: 4449 - DNA, 703 bp, Triticum aestivum
cctccacttcaccgccccgttcccgcgcgccggccgcggtctttcaccgcccgttctacggggccttctacgtctccctcgaccgccgctcgggcgccctcgccgccgtcctctgcctcctctgctgggccgccagctccgccctcgccgcccgactcggcttctccctcggatggaaggtggtattggtagctcagctgttctgttggactatgcaattcattggccatggagtttttgagaagcaggcacctgctctagttgacaaccttgtccaggctttgatgatggccccatatttcgtgcttctagagattcttcacaagtttgttgcgtacgaaccatatcctggcttccatgccaatgtgcagaagctgattgacgctaaacgcaaggagtgggcggacaagaaagcaaagaagatgtcatgaggtgtgaccaagaactcctgatggctgatgctacgtttgctgtgtaacggcgtaagatgagagtgctctaccctggttgccgtttccatgttactgaagataaactgaactgtagactgatatcatcctgagatgtgatacgcttgttgcatgacatcggtgtaagatgagatacgccatgtttggtgttgtgttcgtgttagtggagattttttatataatgaacagtaaagtaataatacattttcaataaagaatctggtgctgtgcct

SEQ ID NO: 4450 - DNA, 549 bp, Triticum aestivum
tggcaggccaaggcgctctcggagcaggccaccgcggtgggccttcacgcgcagctccagcaggccgcctccgcggcgcgggcatcctgcgaggagctgggcggcggcgtacgccggcccggccgtatcgtgctcgtcggcgtacgtagaccctcgccgcgccgggcctgaccgcgcgtgccacggctgccacctcggggcggccacggtggtgctcctgccgtgcagacatctgagcctgtgccgtgactgcttcgccgccggcgacatggacgtggccatggcgtgccctgtatgccattgcgtgaggaccggcagcgtggaggccatcctgtgttgacagagccggcctcggggccatcccgtgccgtgagcgctccgagcaatgcgaaaggcgccatagcttattccggagaatggaaaaatagtcctaaaatggaaaattagattcatttatttctttattagagaatatattgttcatagatttttattaatcattttttaaatgactgaaggttataacatactaaacaagaggaataagta

SEQ ID NO: 4451 - DNA, 1070 bp, Triticum aestivum
acggtttcctgcagccagtgggaatcggaggaagcgcgccagggaggccatggcgccgccgccgccggccaaggaggagtacatcaacctgttcgcgcagcagtcggcgccctttttaaccatggcgcagctccacaacagcagggtcgcgtcgtccccgtcccctgccccggtgacgcgcgtgtccacgggcctccgcctggcattggatgagcagcaacagagacagattaattcattgtgttacccgtcctcgtcctcgccgctcgtccccttctccgatgagttcgccggacagatgaagcagcatggcgacgagctcgacaaattcgtccgggaccagggcgagcagctccgtcgggccatcgccgatcggatgcgccaccacaaccgggcacttctggtggcggcagacaaatcggcctcgcgccggctacgggagaaggcgttggaggcggagtgcgaggcgcgtcgcggcgccgagctggaggagcggctcgcgcggcttcgcaacgaggcggcggcgtggcaggcgaaggcactctcggagcaggccaccgcggtcggccttcacgcgcagctccagcaggccgcctccgcggcgcgggcatcctgcgaggagctggccggcggcgacgccggcccggccgaatcgtgctcgtctgcgtacgtagaccctcgccgcgccgggcctgaccgcgcgtgccacagctgccacctcggggcggccacggtggtgctcctcccgtgcagacatctgagcctctgccgcgactgcttcgccgccggcgacatggacgtggccctggcgtgcccggtatgccattgcgtgaggaccggcagcgtggaggccatcctgtgttgacagagctgtcctcggggccatcccggtcgtccatcccgtgccgtgagtgctccgagcaatgcaaaaggcgccatagcgtattccaacgaatggagaaaatagtcctaaaatggaaacttagattctttctttcttcaaacttttgttcatagttttttttatccttttttacatgccgaggatttacccctcgccgtgtcctcta

SEQ ID NO: 4452 - DNA, 871 bp, Triticum aestivum
tttcaagaagttttgggaggtcatttgatccatctggcttagaggtggcaaccccagttctgctcgagagagatgatggtcataaacacagaagaggaagtcatggcgatatcatctttctaacaagcaggggagaggtgacctcgtacaccccaggcctacttggtcacgatgcgatgtggagatggcagctatcgacaggcgctacatggtccaaccttccatctccatcagggatgatggagaacgtcgtggttcctactctcaagaccttctccctgagagcctatgacccaaagcaggtgatcattgcgggcggagaccaggaggccgtggtgatttctcctgatggcagcctactgacatccattgatctccccgcgcctccgacccacgcgctgatccttgaggatttctccggcgacggtctgaccgacgtcatcctggtgacgtccgggggagtgtacgggtttgtgcagacgaggcagccgggggccctcttcttcagcacgctcgtcggcttcttgattgtcgtgatcggggtgatctttgtctctctgcacctcaactcgtcgaacggtggtaaaccgaggtcgaacggccaaagatgatgactgctacgatctcagccggattctgttgggaggatcttgtgagcatcctcagcacagcagcagtgaggagctgttacagtgtttgaactagacatttttaatatagttagctggagatgtttaacttgtgtaaactttgcacagcttttgtatgtatttttagtgttgaagttttgtttgtggtatgatacgacgacggagctcctacatgacatgattatagttctattactaaagatcatcgattcatataatcc

SEQ ID NO: 4453 - DNA, 1105 bp, Triticum aestivum
gggatagaggctattcatctagcttctggacgtacgctttgcaagcttcatttgacagaaggaggccttcatgcagatattaacggagatggagtccttgatcatgttcaggttgtcggtggaaatggtgctgagcaaactgttgttagcgggtccatggaggtgctgaaaccctgttgggcagttgctacatccggtgtaccagtgcgggagcaacttttcaatgtttctatctgccattacaaccatctcaacctgttccatcatggtgacttttcaagaagttttgggaggtcatttgatccatctggcttagaggtggcaaccccagttctgctcgagagggatgatggtcataaacacagaagaggaagtcatggcgatatcatctttctaacaagcaggggagaggtgacctcgtacactccaggcctgcttggtcacgatgcgatgtggagatggcagctgtcgacaggcgcatacatggtccaaccttccatcttccatcagggatgatggagaacgtctgtggttcctactctcaagaccttctccctgagagcctacgatcccaatagtcaggtgatcattgcgggcggagaccaggaggccgtggtgatttctcctgatggtagcctactgacatccattgatctccccgcgcctccgacccacgcgctgatccttgaggatttctccggcgacggtctgaccgatgtcatcctggtgacgtccgggggagtgtacgggtttgtgcagacgaggcagcccggggccctcttcttcagcacgcttgtcggcttcttgattgtcgtgatcggggtgatctttgtctctctgcacctcaactcgtcgaacggcggtaaactgaggtcgaccggccaaagatgactgctacgatctcagccggattctgtcgggaggatcttgtgagcatccccagcacagcagtgaggagctgttacagtatttgaaccagactttttactatagttagctggagatgcttaacttgtgtaacctttgcagcttttgtatgtatttgtagtggtgaagttttgtttgttgtatgatacgacgaagctccttacatgacatgattata

SEQ ID NO: 4454 - DNA, 619 bp, Triticum aestivum
cgggccatcgccgatcggatgcgccaccacaaccgggcacttctggtgacggcggacaagtcggcctcgcgccggctccgggagaaggcgttggaggcggagcgcgaggcgcggcgcggcgccgagctggaggagcggctcgcgcggctacgcaacgaggcggcggcgtggcaggcgaaggcgctctcggagcaggccaccgcggtcggccttcacgcgcagctccagcaggccgcctccgcggcgcggggcatcctgcgaggagctcggcggcggcgacgccgggccggccgaatcgtgctcgtccgcgtacgtagaccctcgccgcgccgggcctgaccgcgcgtgccacggctgccacctcggggcggccacggtggtgctcctcccgtgcagacatctgagcctctgccgcgactgcttcgccgccggcgacatggacgtggccctggcgtgcccggtgtgccattgcgtgaggaccggcagcgtggaggccatcctgtgttgacagagccggcatcggggccatcccgcccgtgccgtgagcgctccgagcaatgcgaaaggcgccatagcttattccaaggaatggaaaaatagtcctaaaatggatacttag

SEQ ID NO: 4455 - DNA, 701 bp, Triticum aestivum
gccaaatactacctctataaactaatactcttattaggggcagagtacgtaattgtgctaatttccactgtagattttatgtcaaattataaacatagattcttagattaatttgaagtttgattggttgtcaggaaggagcatggtgacaacaacgagggcagttcaggtggcaccggcggcggctgcgggaagcccgtgcgcgagcccaggcttgtggtgcagacgctgagcgatatagacatactcgacgacggcttccggtggaggaagtacgggcagaaggttgtcaagggcaatcccaaccccaggagctactacaagtgcacaacggtgggttgtccggtgcgcaagcatgtggagcgggccgcgcacgacaaccgcgcggtgatcaccacctacgagggtaagcacaaccacgacatgccggtcggccggggtgccggtgccagccgggcgctgccgacgtcatcttcctcggacagctcggtcgtaacctggcctgccgccgtgcaggccccgtacaccctcgagatgctcaccaaccctgccgccggccaccgaggctatgcagccggcggcgccttccagcgcaccaaggacgagccccgggacgacatgttcgtcgagtcgctcctctgctagctcttcgttcccctctggcgtttacatgtgcgtccacgtgtacaatataaatagat

SEQ ID NO: 4456 - DNA, 917 bp, Triticum aestivum
gcggagctactacaagtgcacctacaacaattgctccatgaagaagaaagtggagcgctctctcgccgacggccgcatcacgcagatcgtctacaagggcgcacatgaccacccgaagcccctctccacgcgccgcaactcctccggctgcgcggcggtcgttgcggaggatcataccaacggctcggagcactctggcccgacgcccgagaattcatccgtcactttcggagacgatgaggccgacaagcccgagaccaagcgccggaaggagcatggtgacaacgagggcagttcaggcggcaccggcggctgcgggaagcccgtgcgtcgagcccaggctcgtggtgcagacgctgagcgatatagacatactcgacgacggcttccggtggaggaagtacgggcagaaggttgtcaagggcaatcccaaccccaggagctactacaagtgcacaacggtgggctgcccggtgcgcaagcatgtggagcgggcctcgcacgacaaccgcgcggtgatcaccacctacgagggtaagcacagccacgacgtgccgatcggccggggccgcgcgctgccggcgtcatcttcctccgacagctcggccgtcatctggcctgccgccgccgtgcaagccccgtgcaccctcgagatgctcgccggacacccaggctacgcggccaaggacgagccccgggacgacatgttcgtcgagtcgctcctctgctagctaggcaggctaggccgcggcccttcgttccccctgtggcgtttacatgtgggtccacgtgtacaatataatagatgctacatgtttttttagttgatctgttgagtaaataagcaattgtttgattaatttaatgcaggaatagatcataagcatgatgtttactaagcacatactgatatttga

SEQ ID NO: 4457 - DNA, 666 bp, Triticum aestivum
gtcaggaaggagcatgccgacaacgagggcagttcaggtggcaccggcggctgcgggaagcccgtgcgcgagccgaggcttgtggtgcagacgctgagcgatatagacatactcgacgacggcttccggtggaggaagtacgggcagaaggttgtcaagggcaatcccaaccccaggagctactacaagtgcacaacggtgggttgcccggtgcgcaagcatgtggagcgggcctcgcacgacaaccgcgcggtgatcaccacctacgagggtaagcacagccacgacgtgccggtcggccggggccgcgcgctgccggcgacatcttcctccgacagctcgggcgtcatctggcctgccgccgtgccggccccgtacaccctcgagatgctcaccaaccctgccgccggacaccgaggctacgcggccggcggcgccttccagcgcaccaaggacgagccccgggacgacatgttcgtcgagtcgctcctctgctagctaggcaggctcggccgcggctcttggttcccatgtggcgtttacatgtgcgtccacctgtacaatataatagatacaacatgttttttagctgatgctttttcttgctgttgagtaaataagcaattgtttgattcatttaatgtaggaatactcgataaagcatga

SEQ ID NO: 4458 - DNA, 689 bp, Triticum aestivum
caggcagacatcaaatcaaggtggaatgcacagcatagctgtcattcagatcgagcagcgcgaggaggaagaagagacagctccattggtgtcagcggcatctgccaaccctaccatcgccaatgaggagcacacgacaaatttcttcatcagaacctcccgaggaggagtttgagatgtttgagtctagcaggggcatcaagctgggacttggcgattttgtcttctacagtgtgcttgtggggagggctgccatgtatgatctcatgacggtctatgcgtgctaccttgccatcatcgctgggcttggctgcaccctcatcttgctgtcgatatgcaggcacgcattgcccgcactcccgatctccatcatgctgggagtcgtgttctacttcttgacgcggttgttgatggagccattcgttgtcggtgcttcgaccaatttggtgatgttctgagttctgactaatgttctgtcgttgttgttacatgtgtgtcaagctgaaaagcaactgtgaacatcatgtgggagtgactactactttgttggtcacgtcttgtaggtagacagtcatgtagttatgactaggaaatgtcattgggactttagactcttataaggtagtatcagttttatctgggatcaactagtccatgtcttgtcgtatagtcagttttatttcagtttc

SEQ ID NO: 4459 - DNA, 658 bp, Triticum aestivum
agtcgcagcaccccgattctgccgcccgatcgggcccaaacctgtatgacagggtgggtcagcaggatgattccggtcctgccatggtagaaatgagggatcttggctcagcaagccgtgacatgactacctcaaatcaaggtgtaacagggcagacatcaaatcaaggtgggagcgcacagcatgctgtcattctgatcgagtcagggtcaggaagaagaagaggcagctccattggtgtcagcggcatctgccaaccctaccgtcgccaatgaggagcatacacaaatttctacatcagaacctcccgaggaggagtttgagatgtttgagtctagcaggggcatcaagctgggacttggcgattttgtcttctacagcgtgcttgtggggagggctgccatgtatgacctcatgacggtctatgcgtgctaccttgccatcatcgctgggcttggctgcaccctcatcttgctgtcaatatgcaggcacgcattgcctgcactcccgatctctatcatgctgggagtcgtgttctacttcttgacgcggttgctgatggagccattcgttgtcggcgcttcgaccaatttggtgatgttctgagttctgactaatgttctgttgtcgtagtaacatgtgtgccaagtgaaaaagc

SEQ ID NO: 4460 - DNA, 1272 bp, Triticum aestivum
tccagtgtcctcttctccatgggcgggccatcgccgtcgccctcctccgccggctcgacgccccgctcgaggcgcccaccgggctcctcctcctcttcaaagcatccgccgtcggcgtcctctccgtgttcgcctccgctggtccccatcctcgtccgccagtggcgtacatggtctgcgctcgccgtctatcgtcagactgtcttgggtcttccaggctcccctgagtggaccacctggatcatgcgtcctcgccgtcgcattctatgacctcgtcgccgtggtcgcgccaaggggcccgctcaggatgcttgtggagctcgcatcctccagggaagatgaacatcccggcgctcatctacgaatcacgccccacggtaggcccagccgagacttcctcctcctatgctccggcaatgtggtccgaggagtcgcagcaccccgattctgccgcccgatcgggcccaaacctgtatgacagggtgggtcagcaggatgattcgggtcctgccatggtagaaatgagggatcttggctcaacaagccgtgacatggctacctcaaatcaaggtgtaacagggcagacatcaaatcaaggtgggagcgcacagcatgctgtcattcagatcgagcagcgtcaggaagaagaagaaacagctccattggtgtcagcagcatcggccaaccctactgtcgccaatgaggagcatacacaaatttcttcatcagaacctcccgaggaggagtttgagatgtttgagtctagcaggggcatcaagctggggcttggcgattttgtcttctacagtgtgcttgtggggagggctgccatgtatgatctcatgacggtgtatgcgtgctaccttgccatcatcgctgggcttggctgcaccctcatcctgctgtcgatatgcaggcacgcattgcccgcactcccgatctccatcatgctgggagtcgtgttctacttcttgacgcggttgctgatggagccattcgttgtcggtgcttcgaccaatttggtgatgttctgagttctgactaatgttctgttgtcgttgttacatgtttgtcaagctaaaaagcaattgagaacatcatgtgggagtgattactactttgttggtcacatcttgtaggtagagagtcatgtagttatgactaggaaatgtcattgagactttaggtaacgtcagttttatctgggatcaactagtccatgtctcgtcgtatagttctatcaacatggcatggtattcgagaagaacacat

SEQ ID NO: 4461 - DNA, 482 bp, Triticum aestivum
cgccgccatgctcgccgagaagatgcagacgtacggcgccaccgggtggcttgtcaacaccggctggtccggtggaaggtacggcgtcggcaagcggatcaagctgccatacatccaggaagatcatcgacgccatccactccggcgagctcctcacggccaactaccagaagaccgaggtcttcggcctcgagatccccaccgcgatcgagggcgtgccgtctgagatcctcgacccgatcaatacctggacggacaaggccgcgtacaaggagacgctcctgaagctggccggcctgttcgggaagaacttcgaggtgttcgccagctacaagatcggggaggacagcaccctcaccgaggagatccttgccgctggacccaaagtctgatttcccacgaagcagatgaagagcgcgatgcggtggaattgtgttttttcagaataaagcagtggtgtgtgtgtgtgtgccgtgtaggtc

SEQ ID NO: 4462 - DNA, 719 bp, Triticum aestivum
atcatgctccacccgaccaagtacgccgctatgctcgccgagaagatgtcagacgtatcggcgccaccgggtggctcgtcaacacccggctggtccggcggaaggtatcggcgtcggcaagcgggatcaagctgccgtacaccaggaagatcatcgacgccatccactccggcgagctcctcacggccaactaccagaagaccgaggtcttcggcctcgagatccccaccgccatcgagggcgtgccgtctgagatcctcgacccgatcaacacctggacggacaaggcagcgtacaaggagacgctcctgaagctggccggcctgttcgggaagaacttcgaggtgttcgccagctacaagatcggggaggacagcaccctcaccgaggagatccttgctgctggacccaaagtctgatttcccgccaagcagatgaaaagcgcgatgcggtggaattgtgttttttcagaataaagcagtggtgtgtgtgctgtgtgtgctgtgtaggtcgatgatgatgacgaaaaatgggtccatgtgcggggggtactagtagagttggttccgtatatttttcatgcgcaatgttaagtttctgtcacagattggtgcttgttttggctatgtatagatgcactgtgctttcatatttggaactcggatcggtctgcctgatatgatcgtatgagtgtatgaccctgtcttctcccctgttaa

SEQ ID NO: 4463 - DNA, 950 bp, Triticum aestivum
caaatcgaggctggggtcttcgctgttgggagcctattcgtgctggtgcatttatttgtgagtatactggggaggtcatcgatgagcttaaagttaacttggatgacagtgaagatgattacatttttcagactgtgtgccctggtgagaagacgctaaaatggaatttcgggcctgaacttataggtgagcaaagcacgtacgtatcagctgaggaatttcagccactgcccatcaagataagtgcaaaaaagatgggaaatgtctcgcgtttcatgaaccacagttgctccccaaacgtcttctggcagccagtgcagtacaaccatggagatgacaagcacccacacataatgtttttcgcacttaatcacatcgctcccatgacagagttaacctatgactatggtgtggttggagaagagaccagtcatagagccaagacctgcctgtgtggatcattaacctgtcgtgggttattttgatgtacattgtggtggatcaacatgcaagccaataagctagatgtttctgttgctacctagattgtacctatgtcgtcacattggtttctgcgaagatggcgtcgcttctggagtgagaagacagtaaattatcttggagctgagacagaatgctcgttgccgtgttattgcctcgccatttgttcagatagatacttctggatgattgcgtgtattgatgtatgtactgctgcaaatctgtcttgtcttgcttttttcgccaaccatttgcaaccatctgtgtagtaggctagcgtcagttttaactggattggacctctggctgttagctgcttgcgacttgtccgactcggtgctcgctcttaaaacatgtcgcttggttgtactttctgtgttgccggatgtgtctatgatacccactcgcttcgctggcatgtgggatctggaccagagtgtagtgaaccc

SEQ ID NO: 4464 - DNA, 659 bp, Triticum aestivum
cacgtccacctccccgcccggcgagcacaagcgccccgcgccatctcgcccgcaccctcttttggccaggtcccggctttccaggacggtgatctcatccttttcgagtcgcgcgcgatttcgaggtacgtgctccgcaaaggcgcatccgatctactccgagaaaacagcctcgccgagtcggcgacggtggacgcgtggctcgaagctgagtcccacaacttcgacagggccatgtcggcgatcaccttccagtgcttcgtcgtgcccatgttcatgggcgggacgactgaccacaaaatcgtcgaggagaacctggagaagcttaaggcggccctcggagtctacgaggagcgtctgaccaggttcaaatacttggccggagatttcatcagcctggcggacctgagccattgccccatggctcactacctgctggccagcccctgcgcgtcggtgctcgatgcgtatccgcgtgtgaaggactgggttgatgggatgatggatcgaccgagcgtgaaaaaggtcatggagcttatggatgcgtcatgaaaagagcggtgtggtgtgtgctttgtggagactatgtgagatgtgctggtgcagatgatttgtcttgtttgtaataactctttccatttcgagagaaacttagccga

SEQ ID NO: 4465 - DNA, 637 bp, Triticum aestivum
tggtgtgcctggaggagtcggcgccgagtacgagctggtgcacgtccacctccccgccggcgaccacaagggccccgcgcatctcgcccgcaccccctttggccaggtcccggctttccaggacggcgatctcatccttttcgagtcgcgcgcgatttcgaggtacgtgctctgcaaaggcgcatccgatcttttaagggagggcagcctcgccgagtcggcggccgtggacgcgtggctcgaagccgagtcccacaacttcgacaaggccatgtcggcgatcaccttccagtgcttcgtcgttcccatgttcatgggcgggacgactgaccacaaaatcgtcgaggagaacctggagaagcttaaggtggccctcagagtctacgaggagcgtctgtccaggtcacggtacctggccggagatttcatcagcctggcggacctcagccattgccccatggctcactacctgctggccagcccttgcgcgtcggttctcgatgcgtatccgcgtgtgaaggcttggattgatgggatgatggatcggccaagcgtgaagaaggtcatggagcttatggatgcgtcgtgaaaagagttgtgtggtgtgtgtactttgtggagtggaagttgtctgaga

SEQ ID NO: 4466 - DNA, 628 bp, Triticum aestivum
ctctgctcttcccgcagcagatcccgtcccactgttcacgaagcttctcatcctcttcctccctccctctcgcaccgtccgtgaaagcgcctcgccgtatccgtgctccatctaaccctatcatccaaacacctctttggttagagttagttcaggattagtttagggttagaatctaattctaacctctaaccgagttagagtatctaaacagggcctttgtcgtgcccatgttcatgggcgggacgactgaccacaaaatcatcgacgagaagctggagaagctgaaggtggccctcggagtctacgaggagcgtctgtcgaggttcaaatacttggccggagatttcatcagcctggcggacctcagccattgccccatggctcactacctgctggccagcccctgcgcgtcggttctcgatgcgtatccacgtgtgaaggcttggattgatgggatgatggatcgaccgagcgtgaagaaggtcatggagcttatggatgcgtcgtgaaaagagttgtgtggtgtgtgctttgtggattggaagttatcttttttcttaagatgtgctggtgcatacgattcgatttgtttcaccactctttccatttgaataggacgggatat

SEQ ID NO: 4467 - DNA, 635 bp, Triticum aestivum
agagctattggggactggcacatggaaggaatgaaagcattgtgatggttttgggcctcttaagtgcggagccggaggtgatgatgcggaatctttactgaggaggacgaattcctgatcatcggctgcgacgggatctgggatgtattccgcagccaaaatgcggtagactttgcacgcaggaggcttcaagagcacaatgaccctgtcgcctgctgtaaagagttggtcgatgaggccatcaagaggaagagcggcgacaacctttccgtagttgtcgtctgcttcaactccatagcgcctcctgtcttaacagctcccaggcctcgcgtgcagagaagtatatccgcagaaggcttgagggagctgcagggcttcctcgatagcttggcggactgatatgtgtggcttgagaaccctggcaggtggcagcgctgtagtaatcccatttttccatagcctagcttggaatttaggtttagtatgtgccccatctcataacctgagatggttgttgttgagtaatgcatcactgtaacatattatgcggctaattttatctgcacctggaggtacttatttgcttgtttcggacactgctagacttcacaagtttgaaaggttcacagagattc

SEQ ID NO: 4468 - DNA, 933 bp, Triticum aestivum
  misc_feature (467)..(467): n = any nucleotide
  misc_feature (501)..(501): n = any nucleotide
  misc_feature (621)..(621): n = any nucleotide
  misc_feature (626)..(626): n = any nucleotide
atgggcatggtggtagcacgctgcggactttgtgtgctagcaatgttgccataggttcatcgttgtagggtgatggttttccaggggagatagagtagctgtctcctcagcattcttacagactgatgctgcttttgcagatgcttgctctgtgaactcctctcttgcatctggcacgactgcgcttgctgcactcatcattgggaggtcacttctggtggcaaatgctggtgattgtagagcagttgtatgttgccgtggaaaggcgattgagatgtccagggaccataagccatcttgcacagagagaagatgcgcattgaagcctcaggtggttatgtttacgatggatacctgaatggactgctgaatgttgctagagcaatcggggactggcacatggaaggaatgtaagcatgtgatggtcttgggcctcttagtgccgagccagaggtgatgatgcggantcttaccgaggaggacgaattcctgatcatcggntgcgacgggatgtgggatgtattccgcagccaaaatgcggtagactttgcacgccggaggctccaagagcacaacgaccctgtcgcctgctgtaaagagttggtcgatgaggccatcaanaggangagcggcgacaacctttccgtagttgtcgtctgcttcaactccatagcgcctcctgtcttaacagctcccaggcctcgcgtacagagaagtatatccgcagaaggcttgaaggagctgcagggcttcctcgatagcttggcggactgacgtgtgtggcttgggaacccctggcaacgctgtagtgatcccatttttccatagcctagcttggaatttaggtttagtatgtgccccatctcataatctgagatggttgttgttgagtaatgcatcactgtaacatattctgcggctaattttatctgc

SEQ ID NO: 4469 - DNA, 620 bp, Triticum aestivum
cctgaatggactgctgaatgttgctagagcaatcggggactggcacatggaaggaatgaaagcatgtgatggtcttgggcctcttagtgccgagccagaggtgatgatgcgaaatctcaccgaggaggacgaattcctgatcatcggctgcgacgggatctgggatgtattccgcagccaaaatgcggtagactttgcacgccggaggctccaagagcacaacgaccctatcgcctgctgtaaagagctagtcgatgaggccatcaagaggaagagcggggacaacctttccgtagttgtcgtctgcttcaactccatagcgcctcctgtcttgacagctcccaggcctcgcgtacagagaagtatatctgcagaaggcttgagggagctgcagggcttcctggatagcttggcggactgacatgcatggcttgggagccctggcaacgctgtagtgatcccatttttccatagcctaccttggaatttaggtttagtatgccccatctcatagtctgagattgttgttgttgagtaatgcatcactgtaacatattatgcggctaattttatctgcacctggaggtacttgtttacttatttggacgctgtctagacgt

SEQ ID NO: 4470 - DNA, 1224 bp, Triticum aestivum
cctgcagtccatctaccacattgaggcccgggttcgccgagttcgcccgccaagccgtacgcctcaaagtggtacatgcggatcatgtggcctctgtcctggctctccatggtgctcacgtgggcgtacggttcttggttcaccgttgagaggaatgtcatggagaaactcaataatccagtcttgggccataccaagatacaatttccattatggattgaactgggagaaggaagcaattaataacctgattgtgaaggcaatatgtgaagctgacaagaagggggctaaagttgttagccttggactcctgaatcaggcccagagcctcaacggaagcggagagctttatctacaaaagtacccaaagttggggttgaaactggtggatggaaccagtctagctgctgcagtggttgtcaatagtattccccatggcgcggaccaagttgttctttcaggaaacatttccaaggtggcctgtgctgtggctgcagctctatgcaagaaaaatatcaaggtgataataacaaacaagcaagactatcatttccttcagcccaaaataccagaagatgcagctgacaaccttttactgtcgaaataccggcattgccaaggtgtggataatcggagacggtgcagatgccagcgaacagctcagggcgccgaaaggaacacggttcatcccgtactcacagttcccaccaagaatggcacgcaaggacggctgcacatactcgacgactccagcgatgagcgtgcctaaaacactgcagaatgttcattcgtgcgagaactggctgccaaggagggtgatgagcgcgtggcgcgtcgcggggatcgtccatgcgttggagggatgggacgagcatgagtgcggggacacggtgctcgacatggacaaagtttggtctgctgcactgctgcatgggtttcgccccgtcgccgaagcttgatcgtctggttgcaggtcgagtgaataagcgttaggcagatgaggatgccgtatgctcgctggagccgtgccgaggaagaagaagcagacggttagcagatgagtagcctataattaatcaagtactgctagtttgatctactaccaaggttacttggttagctattactactgcattgttcatctcctatgataatgagttaatgagacttggttcgacctatttctagcgctatctgcccttgcgtcacacaatgcattcacca

SEQ ID NO: 4471 - DNA, 616 bp, Triticum aestivum
  misc_feature (327)..(361): n = any nucleotide
aaggagaacaggccagagaaaaataggttggccgatttcctggaccctgaggtcaagaggtggtcgaatggaaaggaaggaaacctgagagccttgttgtccactctgcaatatatccttggagctgacagtggctggcaaccagtgccgcttaccgatctcatcacagccgctgccgtgaagaaagcctacaggaaggcgaccctctgcgtccatccggacaaggtgcagcaaaggggcgcgacgatcaggcagaagtacatctgtgaaaaggtcttcgatcttctaaaggatgcttggaacaagttcacctcggaggagcgctannnnnnnnnnnnnnnnnnnnnnnnnnnnnnnnnnnagccggattcattttgctagttgcatagccatattgttggttctttccattggatattgctgtaaataggcagctcggtctaggtaccattctagatgatgatagaagactcgaaggcggtctcggttgaaagagagagctccgttgttctggaaatgaattgtgatgttccagtccagacctgggtagcagtctagtctagtagcaggacatctaatctaataggcaccttgactgtggtggagttgaagatta

SEQ ID NO: 4472 - DNA, 1002 bp, Triticum aestivum
gctcgggagagggcgattaagaaggccaaggccgagaaggctgctgcggaggcaagagaacgcagagaacaaatcaggtcctcttccaaggatgttcgacaggacaatcagtttcagagggcaacttccagtggttacgtaagaaatacagattctagtagcaaagtggttgattccgagtcggctttaaggcataaggcaagaatagagaggcatcaacgcacaactgagcgtgtgtcaaaagcactcgcggagaagaacatgcgtgacctgatggctcaaagagaacaggcagagaaaaataggttggccgatttcctggaccctgaggtcaagaggtggtcgaatggaaaggaaggaaacctgagagccttgttgtccactctgcaatacatccttggagctgacagtggctggcagccagtaccgctcacagatctcatcacagccgccgccgtgaagaaagcctacaggaaggcgactctgtgtgtccatccagataaggtgcagcaaaggggcgcgacgatcaggcagaagtacatctgtgaaaaggtcttcgatcttctaaaggatgcttggaacaagttcacctcggaggagcggtaggatgggagtgatggatggatggacagaagccggattcattttgctagttgcatagccatattgttggttctttccattggatattgctgtaaataggcagctcggtctaggtaccaccattctagatgatgatagaagactctgaagcggtctcggatgaaagagagagctctgttgttctggaaatgaattgtgatgttccagtccagacctacctgggtaggtctggactgcaacatcacagttcatttccagaacaacggagcgtctctctctctctttcaaccgagaccgcctcagggtcttctatccatcatctagagtgccgcctagaccgagctgcctatttacagcaatatccaatggagagaaccaacaatatggctatgcatctag

SEQ ID NO: 4473 - DNA, 683 bp, Triticum aestivum
gcggctgttctggtgcatctctgtaatggcgaccagcagcaacagcatcttgcagaagcacaggagcagggcattgtgaccttgctggaggagctagcagaaagcggcacagacagggggaagagaaaagcgatccagttgcttgaacggatgaataggtttctgaagcagcagagccaagcccagggagacgcgatggcacaggcgcatgctcagtcccaaaccctgtcccaggctctggttcaagttcaagcagatactcagctagaggaatcactgcctcctacatcatctcatcttcctgagagatgaggtgaatgatcattagctccccattctaggtagtggtttgtttttgggccgtctgccaggtggaagacctcctgcaattcttgctctgcaggtgtgcgttttggctgtacaatgttgtcaggaataggaaggcccggcagcgcagcgtgatttagggctgtgagcatgttgacaggtcagttttgcaaccatggttggtgctgttaactcgtgtttgtttgtagttggtacaatgtgtcggtgattcaaggtaggatcctcgagttttagggaggtatatcgtcatgcttgtactgggtgcctggtacatgactaatttgtggcttcctagggtggtaattttacttgtctgagaaagaagagaacttcag

SEQ ID NO: 4474 - DNA, 873 bp, Triticum aestivum
gctgttgctgcatcctttttaacttgtgtatctatcagggcaacaagggtaaagctgttagagctggattggtccctatactacttgaacttctaacagagactgaaagtggaatggttgatgaggccctggctatactggcaattctctcgagccatcctgagggaaaggcagccatcagcgctgccgccgccataccaattctagttggagttatcaggaatggatcctcgaggaacaaggagaatgctgcggctgttctggtgcatctctgtaatggtgaacagcagcaacagcatcttgcagaagcacaggagcagggcatcgttaccttgctggaggagctagcagaaagcggcacagacagggggaaaaggaaagcgatccagttgcttgaacggatgaataggtttctaaagcagcagagccaagcccagggagatgcgatggcacaggcgcatggtcagtcccaaaccctgtcccaggctctggttcaagctcaagcagatactcagctagaggaatcactgcctcctacttcatcccatcttcctgaaagatgaggtgaatgatcattagcttctcattctaggtagtggtttgtttttgggccgtctgccaggtggaagacctcctgcaattcttgctctgcaggcgtgcgttttggctgtacaatgttgtcaggaataggaaggcccggcagcgcagcgtgatttagggctgtgagcatgttgacaggtcagttttgcaaccatggttggtgctgttaacccgtgtttgtttgtagttggtacaatgtgtcggtgattcaaggtaggatcctcgagttttagggaggtatatcgtaatatgcttgtactgggtgcctggtac

SEQ ID NO: 4475 - DNA, 622 bp, Triticum aestivum
ttcagttctattcgcagcagtggagaacttgggccgcttgtttcatacaagcggcctggcacaggcgctgcagaaagaagatggaagatgctctgcgcgagaaggaggaaaggctgcaactcgcgattgtgaatgacggttccactccgctcagcttcggtgcggcaatatacgcttcacgttttgctcgcaacatgatgcggatcttgaggagaaatgccacccggaaggcccggctgcaggaaagggtgcccgcaaggctgttgcagaagccagctagaacccaacttttctgcagaggagcagtagtttgcatgaatgccttgatggtgttattcttctgcacgatctgtgcggttgcactcgctgatgcgtgcttacggttttcgctagcggttcaaaggcgggctgggggatcgcagtagcgtgatgaattgaagtgatgatatacttgcttcctggtctcgacactaacactagatttgcttgtatatcacatataggtaatggtgtgatttgagttagtaatctggtcttttgtactactacgtttgtgcatagcgagcgcagcccagtcctctttgtgtaggatgcaaaacatagtcccactgtgttagacagt

SEQ ID NO: 4476 - DNA, 875 bp, Triticum aestivum
tgaggggaccgtaaggaaatgatctttatcacgagagaacctcatgagcatgaccacaccgtggaaaactggcttcttcaactctgatgttctgaaaagtggagatttctgtggcgaggagcttcttacctgggctcttgatcccaattcagcaaccagtctccccagctcaaccaggacagtgaagtcaatgtctgaagttgaagcctttgctttgatggctgaagacctgaagtttgtagccacacagtttcgccggctacacagcaaacagctccggcacaccttcaggttctattcccagcagtggagaacttgggccgcttgtttcatacaagcggcctggcacaggcgctgcagaaagaagatggaagatgctctgcgcgagaaggaggagaggctgcaactcgcgattgtgaacgacggttccacttcgctcagctttggtgcggcaatatacgcttcacgttttgctcgcaacatgatgcggaccttgaggagaaatgccacccggaaggcccggctgcaggaaagggtgcctgcaaggctgttgcagaagccagcagaacccaacttttccgccgaggagcagtagtttgcatgagtgccttgatggtgttattttctgcacgatctgtgcagttgcatcgctgatgttgcttacggtttttgctagcggctcaaaggtgagccggaggttcgcagcagcgtaatgattgaatgatgatatattgctacctggtgtagacagtaacacatataggtaatggtgtgatttgattagttatctggtcttctgtgctgtacatcatttgtgcatagtgagcgcagcctagtcctctttgtgttgccatcagaggatgcagcatagtccc

SEQ ID NO: 4477 - DNA, 629 bp, Triticum aestivum
cttcaggttctattcgcagcagtggagaacttgggccgcctgttttcatacaagcggcctggcacaggtgctgcagaaagaagatggaagatgctctgcgcgagaaggaggaaaggctgcaactcgcgattgtgaacgacggatccacctcgctcagcttcggtgcggcgatatacgcttcacgttttgctcgcaacatgatgcggatcctgaggagaaatgcaacccggaaggcccggctgcaggaaagggtgcctgcaaggctgttgcagaagccagcagaacccaacttttccgcagaggagcagtagtttgcatgaatgccttgatggtgttattttctgcacgatttgtgcggttgcatcgctgatgttgcttacggttttcgctaacggttcaaaggcgagctgggggatcgcagtagcgtgacgattgaatgatgatatattgctacctggtctagacagtaacactagatttgcttgtatatcacatataggtgatggtgtgatttgattagtaatctggtcttctgcacttctggtgatggagtactactttgtgcagcccagtcctctttgtgttgccatcagaggatgcaacatagtcccactgtgttagcagctgat

SEQ ID NO: 4478 - DNA, 609 bp, Triticum aestivum
  misc_feature (594)..(594): n = any nucleotide
  misc_feature (600)..(600): n = any nucleotide
tcttattggcatataccatgattggtgcgaagccttctctacgtaccctaggacatatgacctgatacatgccagcggcgtcttcagtttgtatgagaacaagtgtgacctggaagacattcttcttgagatggataggatcttgcgtccagagggcactgtcatactgcgggacaatgtcgaggtgctgaacaaggtcaggatgacggtgacgggaatgcgatggaagtccaagctacttgatcacgaagatggccctctcgtgcctgaaaaacttctgattgctgtaaaaacgtactgggttggcagcaaagaaggaagcggttcatagactctcttaccctgcgtcaagattttggacttctgattgctgttgggtgccgcgttggctgcagagaaggacacagttcatagattctatgcctgcatcaaggattttggacttccggttgatgttaaagagcagcgaaaaagtacagttcatagattcttatccatgtgcatcgattaatagagcttgttcatagatacagatctctgttgagtacgtatagtggcaaacattataattgtggcagttgacccactgcgtgnggtaangaaagaaca

SEQ ID NO: 4479 - DNA, 738 bp, Triticum aestivum
taaacaattgataggaattcgaaatataggaatatcatgaacatgaatgcagcctcgaatttttctgcagtgcttggattctccggctctggttcatgaacgtttgtgcctacatatcagagaggaacactcttggcatcatctatgagcgggttcttattggcatataccatgattggtgcgaagccttctctacgtaccctaggacatatgacctgatacatgccagcggcgtcttcagtttgtatcaaaacaagtgtgacctggaagacattcttcttgagatggataggatcttgcgtccagagggcactgtcatactgcgggacaatgtcgaggtgctgaacaaggtcaggaggacggtgacgggaatgcgatggaagtccaagctacttgatcacgaagatggccctctcgtgcctgagaaacttctgattgctgtaaaaacgtactgggttggcagagaagaaggaagcagttcatagactctcttgccctgcgtcaagattttggacttctgattgctgttgggtgccgcgttgggaaacagttcatagattctatccccgcatcatgattttggacttctggttgatgttaaagagcagcgaaaaagcaacagttcatagattcttgatccctgtgcatcaattaatagagcttgttcatagatacagatctctgttgagatggtatagttgacaacattcatatgtgcatgtcgataaagaaaatatt

SEQ ID NO: 4480 - DNA, 1005 bp, Triticum aestivum
atttggcagaaaaaggcaaattcaaatgcatgccataacaagaatggtcgtaccagcaagatgtgcaacgttcaagatgcagatgacatctggtataagaaaatggaaacctgtataacacctatcccagagggagcacagcagctacagaagtttccacagagactatttgcagtccctcccagaattctagaaggtaccccaggtgttacagaagaagtctatgaagaggataagaagttgtggaagaagcatgttgatacatacaagagggtaaacaagttgatagggaagtcaaggtataggaatatcatggacatgaatgcaggccctggaagttttgctgcagtgctggattctcccggctcctgggtcatgaacgttgtgcctacgatatcagagaggaacactcttggcatcatctatgagcggggtcttattggcatataccatgattggtgcgaagccttctctacgtaccctaggacatatgacctgatacatgccagcggtgtcttcagtttgtatgagaacaagtgtgacctggaagacattcttcttgagatggataggattttgcgtcccgagggcgctgtcatactgcgggacaatgttgaggtgctgaacaaggtcaggagtacggtgacgggaatgcgatggaagtccaagctacttgatcacgaagatggcccgctcgtgcctgaaaaacttctgattgctgtaaaaacgtactgggttggcagcaaagaaggaagcagtccatagactctcttgccctgcgtcaagattttggacttctgattgctgttgggtgccgcgttaggaaacagttaataggttttgtccctgcatcatgattttggacagcgaaaaagtgacggttcatagattcttgatccctccacatcgattaatagtgcttgttcatagatacagatctctgttgagatggtatagttgacaacattcatatgcgcatgtcgataaagaaacattaattgatgg

SEQ ID NO: 4481 - DNA, 995 bp, Triticum aestivum
catatgaaggaccctgtcagcagggcattatccacctgacatgtgggaatgtagtgccatcgaccagatggaacttggccaactttaagggaaactatttctaaagttggagtaagaaactctctttctggtggctccaatgcccactgcattccactagtcagattcttggcaacaatgagtgctttgaaccctacacatctaacatctacagtcggcgggttctaagtggggagtttgtcgtggttaacaagcatcttctccatgacttgactgagatgggtatctggacacctgctctgaaaaataagataatttatgaagatggttctattcagaagatggaagaaatccctgatgatcttaaagcaatttacaagactgtttgggagattaagcagaaaactctggttgacatggctgttgatcgtggatgctacatcgaccagagccagagccttaatgtccacatggatcaaccaaactttgcaaagctaacttcgttgcatttccatgcttggtccaagggcctgaaaactgggatgtactatttgagaacaagggcagctgctgatgcaatcaagtttactgtggacactggctttctgaaggtcaatggggatgctaatggcactaatggcactaatggcactaacggcaaactagcagaggaagacgatgaagccaaaatggcgcaagtcgtctgctccttgaacaaccgggaagaatgcctggcatgcgggagctagatgcatctcttgcatctgtttttctcttaaccaaggcaggcattacacaaccaagtggtctgatcattggcgttgaataattgagaagtgagtcgtttatgactttatgtaggtgtggttgggtttaagatctgatgagttcctttgctgggcagcccttgacggctgagttgccaacgttggcttgtgttgtatttgtactatctaaaaacatgggttgctgcagctgtaatgtatatatatgta

SEQ ID NO: 4482 - DNA, 712 bp, Triticum aestivum
gatgggtatctggacacctgctctgaaaacaagataattttatgaagatggttctattcagaagatggaagaaatcccagatgatcttaaagcaatttacaagactgtttgggagattaagcagaaaactctggttgacatggctgttgatcgtggatgctacatcgaccagagccagagccttaatgtccacatggatcaaccaaactttgcaaagcttacttcgttgcatttccatgcttggtccaagggcctgaaaactgggatgtactatttgagaacaagggcagctgctgatgcaatcaagttcactgtggatactggctttctgaaggtcaatggagatgctaatggcactaatggcaaactagcagaggaagacgacgaagccaaaatggcgcaggtcgtctgctccttgaacaaccgggaagaatgcctggcatgcgggagttagatgcatccgttgcatctatttttctcttaaccaaggcagccattacacaaccaaacggtctgatcactggcgttgaataattgataagtgagtcgtttatgtaggtgtggttgggttcaagatctgattgagttcctttggtgggcagcccttgatggctggagttgccaacgttggcttgtgttgtatttgtactatctaaaaacatgggttgctgcagctgtatatatatgtatcgttgttcgtgttattgatttg

SEQ ID NO: 4483 - DNA, 688 bp, Triticum aestivum
atttgtgctgtatgtcacacagcaagttcaaggtcatgaatcatacaactgcagatacacactggggagtacccaagctgacatttattcagacaagctattcaattgcactgctgaggatccttcaataattgaaatgctgaagaggatttttgtactgttttcaaagttctgcaagtcaaaagatttcagttcgtggtggatgcttggatatgcggcagcaggggttgtggcgggcgtggtgagctctatactcatcaccatagcagtaagagtcctccgaggagtgttccttgctgccgccaggcgggctgtgagcaaccatagcatcagggtctttgcttaccgtttcaagcgggcgtgccttcttgttgcgtatatatctttcgttggctggatcaccttgcagtacagcaaaatggttgggctgaaggagcttgtgctggacttcaaactcctggagaggttcttgtaaaatgtaaatgggtttcggcaatgtatatcaaataagccgatccccttgtgtgatgtaacctagtgtaacttatcctgccttgcttcgatatgcggccgcccatgaacaggtggatgaatcatgggtggctgcagttggcatggagtaactcccatctgttgtaacctgcagtgcaacatgtgtcaaaagcatcctaatgacagttggggggct

SEQ ID NO: 4484 - DNA, 895 bp, Triticum aestivum
gactccacgagatcatccaatgcaacgtcgaagggtacacatgcagaatcgagggctgtacgatgagctatcgacacgagaaatgaactgtccctgcatgagctcgacatctgaccggtcaagggatgtggaaagaagttcttcatgcacaagtttctgctgcagaaccacaaggttcaccaccgaaacgacgaagcaactgaagaaagctacaggagaggagagggctccaactccaagagatcatccgatgcgcgtggaagggtacacttgcactatcgacggctgctcaatgagcttcgacacgaaaaaggaactgtccctgcacgagcgtgacatctgcccggtcgagggctgtgggaagaagttcttcacgtcacaagtatctgctgcagcaccgcaaggttcacaccgacgaccggccgctcaagtgcccgtgggagggctgcgacgtggccttcaagtgggcatgggccaggacggagcacctcagggttcataccggcgacaggccctacgtttgctgcgagccagggtgtgcagagacgttcaggtttgtatcagattccagccgtcacaagcgcgagacaggccactcaaccaagcagactaaaaccaagacatgaagcaggtgcaaaagttatggtatactagaagcgacaggggtaagtttgtatatagtgcaccagtacccggagctcacgattgtcttcatttagcgaattctattagtaagcaccacaatgggtgtgctttcctatgtacgtatctaatttcgatcattggtcatttctatgattactgatttagctagtctagcagtttagcactgatgttatgtctgatgtattgacgttgtcactatataaatgccatgtttaatatgatcaccatc

SEQ ID NO: 4485 - DNA, 899 bp, Triticum aestivum
catgaatgttcaaagagagcaggcagaaagagatagaatttcggaaagtctagacttcgagattaagcgatgggctgctggaaaagaaggcaatttgcgggcactgctatcaactatgcaatatgtactttggccagaatgtggatggcagcctgtatccctaacagatctgatcactgctgctgcggttaaaaaggtgtacagaaaggcaactttgtgcatccatcctgataaggtgcaacaaaagggtgcaaatctacagcagaaatatatcgccgagaaggtttttgatcttcttaaggaggcctggaacaaatttaactctgaagagctcttctaaacattactatgaggaccatcttcgcccgtgtaaggtactcgagaagtccgcccaccgtgcatcatcacctcctttgactgcttgaggtgctcaaggaggaacgtccaagctggagcggccggtcatgccgtcaggggaaacaatgaagtgatcaagtgaaagccccacccgccattatttgttattgtattgctgtttgcttactgcatccatcttccttccaccttgtgcatgtgttgattcgacgactattcgcagctgctacatgccagcggaccttcaaccagtaggtgtatattagcgtcctttttgctcggttgatggtgggttgtgtgtagcagcggagcgggttcggtgttgtgatttttggggtccaatgtgcttcattttacttcgggaaggccaacgttacatggattcatggcttgtcacctgtttgatgccatggccactgtcatacgttatgttgtgttgtttattgggaactgctggtgcaaccatgggagttggagccgtgcctagtgatttttttcctgtatgatttcgttataaagttgat

SEQ ID NO: 4486 - DNA, 665 bp, Triticum aestivum
taaggaccacggaatgagcatgaggcccatccctggcatgtttgtctgatatcttctagttccaaggagaagaggaaccacgccaaccaaccatccgatgtcaaaaggacacgtagggatcgccgggaactggaaaacattatcttcaagcttttcgaaaagcagcctaactgggcactgaaggctctagtgcaagagactgaccagccagagcaattcctcaaggagatattgaacgacctctgtatgtacaacaaacgagggccaaaccagggcacgcacgagctcaagcccgagtacaagaagtcgtctgaggacgctgccggtgccccgtgaagatgatctatctgttttggcggctgttgtgtaactgtgataccaggaacctgttggcttgatgcgcggaactatgagttgtctatgtgaagcctccagtcatgcttgggctgcatttgcttgctttttattaagaggcattgttgtaattgtatgggtataagatgatacatatacaacacatgtcacagagaggaaatggatctactgataaaccacacgaaagattgtttgattttctgggtagatgtaagaatcatgtcgaggattcgacgtgtgcgatccttgttccttttgagaactcccgtacttcaataccatccagatgt

SEQ ID NO: 4487 - DNA, 639 bp, Triticum aestivum
tcagggaaactctcatgtgaaggaaaagtcgagcataaattcgacatggaacctcacaaggataacttattaaactacgcgaagttatgccgtgaaagaacacaaaagtcgatggttaaaactagaaaagtgcaggtacttgataatgaccatggaatgagcatgagacccatgcctggcatggttggtctgatatcttctagttccaaggagaagaggaagccaacgccaaccaaaccatccgatgtcaaaaggacacgtagggaccgtcgggaactggaaaacattatcttcaagcttttcgaaaagcagcctaactgggcactgaaggctctagtgcaagagactgaccagccagagcaattcctcaaggagatattgaacgacctctgtatgtacaacaaacgaggtccgaaccagggcacgcacgagctcaagcccgagtacaagaagtcgtcggaggacgccgccggtgctgctccgtgaagacgatttgcgtatccgactgctgttgtataaccgagtacctgttggctttgatgtgcggaacgatgagttgtctatctgaagcctccgatcatgcctgggctgcatttgtttgctttttattaagaaggcactgttgtaactgtatgggta

SEQ ID NO: 4488 - DNA, 869 bp, Triticum aestivum
cctccagttcaagatggagatgtctcaaactagtgtagccagcacttgcaatctaccaaagagttactccttgaatatgttcaaggattttgtacccatgtgtgttttctctgagactaatcaaggaaaactctcatgcgaaggaaaagtcgagcataaattcgacatggaacctcacaaggataacttattaaatacgcgaagttatgccgtgaaagaacacaaaagtcgatggttaaaactagaaaagtgcaggtacttgataatgaccacggaatgagcatgagacccatgcctggcatggttggtctgatatcttctagttccaaggagaagaggaagccaacgccaaccaaaccatccgatgtcaaaaggacacgtagggatcgccgggaactggaaaacattatattcaagcttttcgaaaagcagcctaactgggcactgaaggctctagtgcaagagactgaccagccagagcaattcctcaaggagatattgaacgacctctgtatgtacaacaagcgagggccgaaccagggcacgcacgagctcaagcccgagtacaagaagtcgtcagaggacgccgccggtgctgctccgtgaagatgattcgcgtatccgactgctgttgtataaccgagtacctgttggctttgatgcgcggaacgatgagttggctgtctggagcctcagatcatgcctgggctgcatttgcttgctttttctttattaagaggcattgttgtaactgtatgggtataagatgatacatatacaacacatgtcacagaagggaaatggaaatactgataaaccacatgaaagatcgtttgatttccagggtagctgcaagaatcatgccgagg

SEQ ID NO: 4489 - DNA, 869 bp, Triticum aestivum
atggacgggcacgtcggccagttcttccagtcggtcagctcgatcttccgcgggagcgacaccctccccgtctgcgaccgcgacatcatcgccggttgtgagacagaggttgctgaggctgcaaatgaagaacagaagaacgacagcctcatgaggctgtcatgggcgcttgttcactctaggcagcccgaggatgtcaaccgtggcattggaatgcttgaagcttctttcggcaagtctaacagtccgctacaaacaagggagaagctctatttgttggccgttggacactacagaaatggggattacacaagaagccgtgagcttctggaaagatgcttagaggttcaacctgactggaggcaagctcttactttggaaaggctccttgaagagaaaaccaaaagagatgttatgattggcatggccattgtgaccggcgcctttggacttgtggggcttgttgctggtggaatcatagctgctgcttcatcgtccaggaagaaatgaggctccggtatgcggtgaataagatgattagatgagcaagaacttgatgtgaagttgcgtaatcttaccttggcactcttgcgaccatgcatgtgcgcacttatccttgtcctgtcctgtttccatgttggaccaaccttaatcgcactattagtaaatacgacatttcaactgtcggatcgaagaatgtatgttaagctaatgctagatcatagactgttgcattggttcatatcattctgataatccatcttacaagcataagaggagctgtatcttatgccaacgtaagatcgatgttgacgcgaaaatttcagaagagcataagatggaaggaagagaattatttttggttttaa

SEQ ID NO: 4490 - DNA, 675 bp, Triticum aestivum
gtgatttccaagagctttgagcggatccaccgaagcaacttggtcgggatggggatcatcccgctgtgcttcaaagccggggaggatgccgactcactcggccttactggacatgagcgctacaccatcaaccttcccaccgatgtcagcgagatccgccctggccaggatgtgaccatcaccacggacaacgataaatccttcacttgcatacttcgctttgacacagaggtggagttggcctactacaaccatggaggcatcctgccctatgtaatccgcaacatggcagcagctcagaactaggcgaaggcgcacacaccctttccgccaacgatggcggcatgccaatcttgttagtgccaccatcaacgtcgagcgttcactcttgattttgtggccttatgaataaaccgaaaataaagccggcatttccatacctggcgtgggcgcaagttgatttgtgggtgtttggttgtggttatgaaaccgtgtggtcattctgaagagacatccaattgtggaggattaaaatcgtagagtctggtgtacattgctttgtgccaaaaacatatataaactgatagcaatctggagttcttttttaacctttacctcaccaatctactgcctgccttacatactgtagtgacctttatattactaaggtgccac

SEQ ID NO: 4491 - DNA, 834 bp, Triticum aestivum
ctgttttcgatgcggccacgaaatacaaatctgaaggtcatggatacgatcattcttgctggcgccgagtatgggagtggcagctctcgtgattgggctgtccaaggggccgatgcttcttggtgtgaaagcggtgattgccaagagctttgagcggatccaccgaagcaacttggtcgggatggggatcatcccaatgtgcttcaaagccggcgaggatgccgactcactcggccttactggacacgagcgctacaccatcaaccttcccaccgatgtcagcgagatccgtcctggccaggatgtgaccatcaccacggacgacgataaatccttcacttgcatacttcgctttgacacagaggtggagttggcctactacaaccatggaggcatcctgccctatgtaatccgcaacatggcaggagctcagaactaaggcgaaagaacgcgggcgtgcacacaaacacacaccctttcgaccacgacggtggcacggcagtcttgttagtgccatcgtcgacgtcgagggttggtttagaatttcgccgggcttcgttcgctttacaaataaaccggaaaataaagccccgtaggagacagagaaagggcattttcgtacccgatgctcatcttttggctgtgattatgaaaccatcattcggaacaaatcttcagttgtggattaaatcgttctgtagtgatctttcgggctgtttattttttcttttcctctttgaatgtgctgtagtggccttattacatcatcgtatttgtcttgcagaacaattttattttatatgtatgtatactaattttatagacatagaatac

SEQ ID NO: 4492 - DNA, 796 bp, Triticum aestivum
tacaagtctgaaggtcatgatactatcattcttgctggcgccgagtatgggagcggcagctctcgtgattgggctgccaaggggccgatgcttctcggtgtgaaagcggtgatttccaagagctttgagcggatccaccgaagcaacttggtcgggatggggatcatccctctgtgcttcaaagccggcgaggatgccgactcactcggccttactggacatgagcgctacaccatcaaccttcccaccgatgtcagcgagatccgtcctggccaggatgtgaccatcaccacggacaacgacaagtccttcacttgcatacttcgctttgacacagaggtggagttggcctactacaaccatggaggcatcctgccctatgtaatccgcaacatggcagcagctcagaactaggcgaaggcgcacacaccctttccgccaatgatggcggcatgccagtcttgttagtgccaccaccaacgtcgagcggtcactcttgattttgtggccttatgaataaaccgataataatgccggcatttccatacctgggcgtgggcgcaggtcgatttctccggtgtttggttgtgtttatgaaaccgtgtggtcattttggacagatattcaattgtggaggattaaatcgtagagctcggtgtacattgctttgtgctacaaacatatataaactgatagcaatctggagttcttttctgaacctttacctcaccaatcgactgcctggctttacatacctgtagtggcctttatatatttactaaggttgcccactgct

SEQ ID NO: 4493 - DNA, 852 bp, Triticum aestivum
gctggtgatggcgcttctgtcatcataaagtctctactggacagagctacagagcttcttactgatcaacatgtggcctctgcttacagcatgcagaaccgaactctatggcaggcatcatttgatgccttctttgggctgcttatggggtattgcatgagtaaatttgatactgtggttcatacagtgcaaattcaacctgctgctgcagctgtgataagcagggaaacaccagtggagctgttgcgtgccagccttcctcacacaaatgagtatcagcgcaagcagttgctcagtttcgctcagcgcactgtgcctgtcaacagctctagttctcatgggtctggtaatgtgccgatggcatcagaatatgtccagagctgaaatagaagaacagagctgcttttcataatctatatacttgatatggttcttgcgagtggtgggaagaacatagatattgtggtgacgacaaagaatgatggtctcggtcaaatatacaaaggatgatcttcggccactttaggaagctgaaattgatgaattatgttgctgagactgaggtagagaaggctgctacaatggatggtgcccgaggggaacatgatcgctggatgtgttaagccttcattctgtcagccaaaacttttagggtgctttctgttgcattccattgcacgatctaaacttgttttagcgctttagttttgttattcgtatatgaattttgttgttttctcgatggcctgtaagctgttcttctgttcttccggcgcttgaattggcacaaattattactgcaagccttgcgtatcagcctgacatttgaacatgctgacaaatcaacatttc

SEQ ID NO: 4494 - DNA, 1092 bp, Triticum aestivum
cttttttctcccagatggacgaccaacttctagatgccatatgtgtgcgtcttgtatcatcactgtgtacaaagggcacatacattgtccgtgagggtgatcccgtggctgagatgcttttcatcatccgtgggaaactggagagctccacaacaaatggtggccgcacaggcttcttcaattcaactacactgaaagctggtgatttctgcggcgaggaacttcttggatgggctcttgtcccgaagcctaccgctagtttgccatcatccactcgcacagtgaaggcactcatagaagtggaggccttttcactccaggccgaggatctcaagtttgtggccagccaatttaggcggttgcacagcaagaagttgcagcacactttccgatactactcacaccattggagaacatggggcgcgtgcttcatccaagctgcgtggcggcggtacaggaggaggaagatggcgaaggacctgagtatgagggagtcattcaattccgtgagatcagaagactcggatggtttagatgaccctccaacccagaagaatatctctctaagaatgatggccgggaaagtcatggctgggaacaggaaagggcttcaggccataaaagagttgccgacactgaagaagccggacgagccagatttctcggtcgaaccctacgagtaaggtataatgttctacccagaacggtcactgatcctctagctctgctaccaagttagtctgtctttgctgcattgaggagactgtaatccggttggaatttggattcgcagaaccggtcgttgatgcaagaattctaattaacactgaatcccaaatgcgcggtgggagaccttacgaagagatgctaaacagattatactacacatagatattctagtcataattacgttgtacattcagatgtttatctgtgtttgtaaaattcttggtgcctcagcacagggcgctgctacactgactgtctgagcttcaaagaaatcctgacattgaagccatagtatggagtacctttttgcagtctttttagtacgaggtttgctacatattttgttaaaagtagactgtaaat

SEQ ID NO: 4495 - DNA, 784 bp, Triticum aestivum
ggagagaacacacgcaacggatgcacgaggaggaggcaaggtaagcctgctgcctgctgccgccccgtccctcctcgccggccggccgccacaggtttcaagatgtcaacctgcacgtttgcagcttcctgtgccctcttgggcaatgctcgaacaaccgatgccccccagaaagcggtcaagagccgcctgagcttcctcggccgaggcgcgccgcagctgcggagcctgaggtcctccttcccctccaagaagctggacgtctccgcggcggccacgtacaaggtgaagctggtgaccccggaaggggacgagcacgagtttgaggcgccggacgacgcctacatcctggactcggcggagacggcgggggtggagctgccctactcgtgccgggcgggggcgtgctcgacctgcgcgggcaagatcgaggctggcgcggtggaccagtcggacgggtcgttcctggacgacgcgcagcaggaggagggctacgtgctgacatgcgtggcctaccccaagtcggactgcgtcatccacacccacaaggagggcgacctgtattaggagggctctcatctctggtgcccccagttggttgtgtgttgagtagaacaaggtctgtctgtaaaacaaaccttggtggttgtttatcccgtgcctgcctgtgtgcgtgctttggtcgttattagtcggaggtggttaagattgttgggtgaagaggccacccatggagaaggcgaataaaatctgactgtgactgatggcatcataaagcagtttg

SEQ ID NO: 4496 - DNA, 663 bp, Triticum aestivum
  misc_feature (485)..(504): n = any nucleotide
cgcctccagcatcctggagaacatagcctacggcaaggaagcgcgacggaggaggaggtggtcgagcgccaagacggccaacgtgcacgcgttcgtgagccagctccccgacgggtaccggacggcggtgggcgagcgcggcgtgcagctgtcgggcgggcagaagcagcgcatcgccatcgccagggcggtgctcaaggacccggccatcctgctgctggacgaggcgacgagcgcgctggacgccgagtcggagagcgtgctgcaggaggcgctggagcggctgatgaaggggcggacgacggtgctggtggcgcaccggctgtcaacgatccgcggcgtggaccgcatcgccgtggtgcaggacgggcgcatcatcgagcacggcgggcactcggagctcgtggcgcggcccgagggcgcctactcccggctgctgcagctgcagaaccaccgcaactgatggaaggacctgatcgatgccnnnnnnnnnnnnnnnnnnnngggcttgatttttgtgggtggtggtggtctggtctagtgggtgtagatactagggcgaccgtgtgttactggtctcttttctttgtgtttgaactgcaaaccttgtgatctgatcttgatcttgatctgtatcttctccgtgatgaaatgcatgatgcg

SEQ ID NO: 4497 - DNA, 582 bp, Triticum aestivum
ccaagacggccaacgtgcacgcgttcgtgagccagctccccgacgggtaccggacggcggtgggcgagcgcggcgtgcagctgtcgggcgggcagaagcagcgcatcgccatcgccagggcggtgctcaaggacccggccatcctgctcctggacgaggcgaccagcgcgctggacgccgagtcggagagcgtgctgcaggaggcgctggagcagctgatgaaggggcggacgacggtgctggtggcgcaccggctgtcgacgatccgcggcgtggaccgcatcgccgtggtgcaggacgggcgcgtcgtggagcatggcgggcactcggagctcgtggcgcggcccgagggcgcctactcccggctgctgcagctgcagaaccaccgcaactgatggagggacctgatcgatgccatgggtggatggatgggggcttgatttttgtgggtggtggtggtctggtctagtgggtgtagatactagggcgaccgtgcgttactggtctcttttctttgtgcttgaactgcaaaccttgtgatctgatcttgatctgtatccttctccgtgatgaaaatgcatg

SEQ ID NO: 4498 - DNA, 503 bp, Triticum aestivum
tgtgcccgcagcaggagttgctggagcacgaggccgtaggggtgttcctcacgcactctggctggaactcgtcactggagggcatctgcggcggcgtgccgatggtgtgctggcccttcttcgcggagcagcagaccaactgccgtttcaagtgtacggagtggggcatcggtatggagattggggatgacgtgaggaggaccgaggtggaggccatgatacgggaggccatggagggggagcaggggcgtgagatgcgacgacgcgtgctggagcttcgccagagtgctgtggcctctgcacggcatggcggaaggtccatgcgcaatgttgataggctcatcaaggaggtgcttctggcttgaaacaagcaaattaagctggtaaaaataaatggtttggcgagtctgaagcgtttattaagacgtaaccaactcctctccatttgaaagcttaagtcatgttttgagtgatagtttacatggattaccaagatttgctac

SEQ ID NO: 4499 - DNA, 581 bp, Triticum aestivum
cttgtcaaggcgacttcaaggccgctacttctgccgggagttctatgcggcaactgaggggcggagcattgttgtcgactggttgcccgcagcaggaggtgctggagcacgagtccgtaggggtgttcctcacgcactctggctggtactcgtcgctggagggcatctgcggcggcggtgccgatgtgtgctggcccttcttcgcggagcagcagaccaactgccgtttcaagtgtacggagtggggcatcgggatggagattggggacgacgtgaggaggaccgaggtggaggccatgatacgggaggccatggagggggagcaggggcgggagatgcggcgacgcgtgttggagcttcaccagagcgctgtggcctcctcacggcgtgacggaaggtccatgcgcaatgttgataggctcatcaaggaggtgcttctggcttaacaagcaaattaggctggtaaataaatgtttggcgagtctaaagcgtctattaagaagtaaccatccctctccattttaaagcttcagtcatgttttgggtgataacttacatggattaccaagatttgttacaaa

SEQ ID NO: 4500 - DNA, 755 bp, Triticum aestivum
aagattggaaagttgcacgagcaattgctattatgaccacccattccaaaggcaaatgattcccactcgattcagattattttaccacaaagcactttgggcgcaaggtcagacatgtatgtctttctggttgctcgtacactcacaatgtcgcgccaaaagggaagttcattgcatttgtgtctgccgaagcggagactgataatccacagtccgaactaaagcctggaattgatctacttggtccagtagatgaattgtttttcgatatgtatgacagatatgaaccagtcaatgaaccttctcttgataattgctttgtctcatcgagttatgatgccactactcactttgagacgactgtgacagatgttcttaatatgtacacactgattactggaaagactgttgatcttagcgttgatctcagtgctgccagcgctgcagaagagtactagatctcaaacccagaattttcttcaagacatacttcctggaggacgaggaacaccaccggaatcctactgtgtgatggtcacgtgtgacatcagctgcgtactgcgtagggttccaggtccacgcctgctaccagcactatgcgaaattattatctttggaatggtgctgggttccttcgttaacttccatattgatccactgggttgtaaacgttattctatcataacgatggctttgacatgttaatgttcgtcttgtcgatgtattctacagttatacatacttggtgtcttgga

SEQ ID NO: 4501 - DNA, 919 bp, Triticum aestivum
gttagataagctagagtgcaaggttgaatttgatatggaggggaaagtgtgtggtgttacgtcagaaggtgaaactgctaagtgcaagaaggttgtctgtgatccttcttacttggccaacaaggtaaggaagattggaaaagttgcacgagcaattgctattatgagccacccaattccaaatgcaaatgattcccactcgattcagattattttaccacaaaatcaacttgggcgcaagtcagacatgtattcttctgttgctcgtacacccacaatgtcgcaccaaaagggaagttcattgcatttgtgtctgcagaagcagagactgataacccacagtccgaactaaagcctggaatcgatctacttggtccagtagatgaattgttttttgatatgtatgacagatatgaacccgtcaatgaaccttctcttgataattgctttgtctcatcgagttatgatgccactactcactttgagacaactgtcacagatgttcttaatatgtacacactgattactggaaagactgttgatcttagcgttgatctcagcgctgccagcgctgcagaagagtactagatctcatcaaaccaagcattttcttcaagactatactaaatggaggaacaccaccggaatcctactgcaggatggtcatgtgtgacatgagctgcatactgcgtagggggttcaggtgcgtagggggttcaggtccacgcctgccagcagcactatgcgaaattattatatgtggaatggtgctgatttccttcgttaacttccatattgatccactgggttgtaaacgttattctatcgtaacgatggctttagcatgttcatgttcgtcttgttgatgtattctacagttatacatattggtgtcttggatgtattttccttccgagta

SEQ ID NO: 4502 - DNA, 1154 bp, Triticum aestivum
gccatcaagtcatttttctcgactcctcagaacaacttcaggatttttgtgaatggctccttaggttttggtggcatgggaggtggtgctgataagggtccttgctaatgaaacagagaagtgtcttgaagatctgaggaaggttagtgggctacaactatctgactttattgagctcctgtcagaggcaatatctaaatctggagtattggataaacttttggccactcaaaaactggatgatcatgacatcgaaggggcaattcatctgtattacgacatcatctctcagccttgtttggtctgcaaaaatataactgatgctgagctattgcacaagtactctgtgttgcattctcttcctttggacaagagctgtaagatagtcagggactttcttatttctgctaccgcgaaggactgtagcctcatgatgtgctttcggccacgagagtgtgagagaacagatcctgagtatgattcagtgtttcttcagtcagtgaaccgaacctatgattacaaggcttactttgttgatctggatgtgaagcctctggataagatgacacattattttaaattggaccagaagatcgtcatttctacactaagagcggggaggtcgggcgagtcccttgtgattctcagaagggggttggcaccagtgatgacacaacggttcagccacaacattgagttgctccttcaacttgaagcctctggaccggaaagggcacatgccattggtcctgttgtttcgccttgtccctgttgttgtaaccttgtaagtacagctccattgtcgaggagctcttcccttccatcgggaaaaaaagatgccgcagagcggccactgctgtttgttgtcgctgttactgtagcttatgagtggtacatcatgtatacctaccgccaccaggtggctcgtcgcggcagaaaacacaccaggaattcgatacacagacaccaagatgcatgaacagacttttttacagtggcaaccacatgttgccgtatctgcagcagagatgggagcccaggtttgccttgtaggctacggtgtagccatttcaccggttccctctccacctggtaaccggcgtatgtaccaatgtactccctccgtccggaaacacttgttatcaaatgaataa

SEQ ID NO: 4503 - DNA, 623 bp, Triticum aestivum
gtccggcgtatcctctggtctgggctagggttcctgatcacgcaggtcgggctcttcttcaggctcaccttctgggagttctcgtgggacgtcatggagcccatcacattcttcacaactgcgacgggcctggtcgtcgggtacgcctacttcctcatcacatcaagggacccgacataccgggacttcatggagaggatgttccagtcccggcagaggaagttgatccagaggcagaagttcaacctggacaggtacctggagctccagaggtgctgcaaagatcctctggagaagatctgcggcaccagccatttctccaacgccgacatcgcgcatctgcacgagctgtctgtccacaagtgacggacggccctcccgtcgctctaaaacactaatctacagtgcccccttttcatctttgattctcgtgggatgatgatgaagaagaaagtattaacaaaccggatgtttcttgcgcttgcgaggtggacctttggcaaaacctttttcgtggtctctctcctttgcaaatgtctaggccagcaaacccagtatagctatgtctctctcttttgtacattgctgaagcagaagcacttgatcctgatgcttgtactgct

SEQ ID NO: 4504 - DNA, 1205 bp, Triticum aestivum
  misc_feature (136)..(136): n = any nucleotide
tgcgccgccgccaaggacgtcttcctcagccagcccaacctcctcgagctcgaggcccccatcaaagtctgcggggacatccatggccaatattctgatcttcttcgattatttgagtatggtggtttcccaccgngaggcgaactatttgtttctgggtgactatgttgatcgtggcaaacagagtattgaaacgatatgccttctgcttgcttacaagattaagtacccggagaacttctttctccttaggggaaaccatgaatgtgcctctatcaacagaatctatggattctttgatgaatgcaagaggaggttcaatgttcgtctctggaaggtttttactgactgttttaactgccttcctgtggctgcacttattgatgacaagatcctgtgcatgcatgggggtttatcacctgatttaaagaacatggaccagatacgtaacattgcccgtcctgtggatattccggaccatggtctcctctgtgatctgctatggtcagaccctgataaagatgttgatggctggggtgagaatgacaggggcgtgtcatacactttcggagctgataaggttgcagagttccttgagaaacatgatctagatttggtctgcagggctcaccaagtgttggaggatggatatgaattctttgcaaagcgtcagctcgtaaccatattctctgcacccaactattgtggcgagtttgacaatgctggtgccatgatgagcatagatgattcactaacatgctcattccagatccttaagccttctgataagaaagggaaagctggaaccggcaactcaaaacctggaacaccgcctaggaagataaagattaatattatttaggcagacccttcaggtatgaaatgagttattgtgatggagcacacccccaaaacttgttatgaaggtgcgccgaacaacctgttgaaaacgtcaacctgcatgctgttgttttttcgtggtctgatgcagatctgtcctgccattctggaaagatcagagcaggaaacataactgggaattttgtgtggattttttattccttttattaactctgctatgcgtggcaaaatgtttaagcacgggaggcatcaggaacctcatcctgtggtggagattgccaatgctgaatgtagattctgttatgttatgtacgctgttttatctgtaaagctcgcctctgcaa

SEQ ID NO: 4505 - DNA, 657 bp, Triticum aestivum
ggagttttgcaggcaagtggacaaagattgtgagttactagagcaggagaggatcatggatatagtctttttggttggcattcacttcaaagatcgatttaacggcaatgctgacaacggtggtgctgaagattctgagcaaaataagaaagcgaaactggggatcgccatgcagtcgagggtggagaacgttgtgcggaaccccgagagcgagtcgcctctcatcggtgatcccacgggagaatttcgggaggtggtcctcttcttcggcatcatcgacatcctgcaagactacgacatcagcaagaagctggagcacgcctacaaatctcagctgtatgatcccaactccatatcggccgtcgaccccaagcagtactgcaagaggttcagggacttcatctacagggccttcactgaagacgtgcagtgatcacttcttggcacctccccgccgaagctggctgaaggaacatgattgttggattgttctttcggtcggagatcaatggcacgacaaattttggttctctggggattgttcatagaccatgtacatttttttgctaatattcctcctttccttaactgggtaactaggtctagtgtgtaacgcgcccatgctgattggcctgaaaagcatgtagaaccagagac

SEQ ID NO: 4506 - DNA, 524 bp, Triticum aestivum
attctgagcaaaataagaaagcgaaactggggatcgccatgcagtcgagggtggagaatgttgtgcggagccccgagagtgagtcgccgctcatcggtgaacccacgggagaatttcgggaggtggtcctcttcttcggcatcatcgacatcctgcaagactacgacatcagcaagaagctggagcacgcctacaaatctcagctgtatgatcccaactccatatcggccgtcgaccccaagcagtactgcaagaggttcagggacttcatctacagggccttcactgaggacgtgcagtgatcacttcttggcacctccccaccgaagactggctgaaggaacaggattgttggatcgttctttctgtccgagatcgatggcgcgacgaattttggttctctggggattgttcatagactatgtacatttttttgctaatattcctcctttccttaactgggtaattaggtctagtgtgtaacgcgcccatgctgatggcctgaaaaggatgtagaacagaga

SEQ ID NO: 4507 - DNA, 570 bp, Triticum aestivum
gccccttccaggaccagaaagaagccccacgatcgtccggtccagctactagttccgcgacgcgatcgtccggtttatttatctgtatctggttaatcgcagcagtttggagctgtcagattcgagtagctagcttagcatctcgagcgagaagaaggatcgaggagatgagcggcggcggcggaggagcggcggcgacgcaggggcagcaggatctgcagctgccgccggggttccggttccacccgacggacgaggagctggtgatgcactacctctgccggcgctgcgccggcctgcccatctccgtgcccatcatcgccgaggtcgacctctacaagttcgacccatggcagctcccaagaatggcgctgtacggcgagaaggagtggtacttcttctccccgcgcgaccgcaagtacccgaacgggtcgcggccgaaccggtcggccggcacgggctactggaaggccaccggcgccgacaagccggtgggcacgcccaagccgatggccatcaagaaggcgctcgtcttctacgccggcaaggccccaagggcgaaaagaccag

SEQ ID NO: 4508 - DNA, 726 bp, Triticum aestivum
ctaatgtgaaccccgaccgggaaggcccgacgactgctcgagaattgctccagaagcacggcgaggtcgtgtacagctccggcggggccagcagcgcgtctctggccagcgagccgacgaggacgccgagtgcctgtcactggctgtttctctggctaaagttgcaagcgaggtccaaggccgccgacattcgtgtgctgttcgtgaagccgattgtctactggaccgagttcttcatcatcctcaccgccttctcgaatgcacagattgaggccatcagttccaaaatgagagacatcggggagcagcagttcagcagagttgcgtctggtgatacaaaacccaattcatggaccttgctggactttggcgatgtcgtcgtgcatatatttcttcccccgcagcgggagttctacaacctggaagagttctacggcaacgccactcccatcgaactccctttcgagacccagctgcagtaactaccgctcgaatcttggcattggagccaaacgaggacggtcactcaaagacccgcaggtagatagatagcttggtcgcacagctggacaggacagtgatgccgggtgaccactctcctgaagtatgcgaaattggcgccgtcatgcaaacattcttgtaatctgttgttataccatgtgtatcattgtagcaactaagcaccattgaacaatgttaacagcaagaggaatagaatccagaaag

SEQ ID NO: 4509 - DNA, 731 bp, Triticum aestivum
cgggacaggggagggcgcggacgagctgctcgaggaatgctccagaagcaacggtgaggtcgtgtacagctccggcggggccagcagcgcggccctggccagcgaggccgacgaggacgccgagtgcctgtcactggccgtttctctggctaaagttgcaagcgaggtcaaggccgccgacatccgtgtgctgttcgtgaagccgattgtctactggaccgagttcttcatcatcctcaccgccttctcgaatgcgcagattgaggccatcagttccaaaatgagagacataggtgagcagaagttcagcagagttgcgtctggtgatacaaaacccaattcatggaccttgctggactttggcgatgtcgtcgtgcatatattccttcccccgcagcgggaattctacaacctggaggagttctacggcaacgccacccccatcgaactccctttcgagacccagctgcagtaatcgccgctcgaatcttggcattggagccaaacgaggacgttcactcaaagacctgcagatagatagatagcttggtcgcacagctggacagtgatgccgagtgactactctcctgaagtatgtgaaattggcgccatcatgcaaacattcttgtaatctgttgttataccatgtgtatcattgtagcaactacgcagtacgcactattgaacaatgtttaacagcaagaggaatagagttcagcaaagattggcgg

SEQ ID NO: 4510 - DNA, 562 bp, Triticum aestivum
tgaagtcagggcagatcacacaggaatatgatcagcacttggggcggtggaacactattacctttgtagataataataggaggtttgtgacatctagcgatgacaagtctcttcgtgtgtgggagtttggcatccctgtagttattaagtatatcagtgagccgcacatgcactccatgccgtctattgcagtacacccaactctaactggctggcagcacagagcttggacaatcagatactgatatacagcacgaaggaaaggtttcaacttaataagaagaaaaggtttgcaggccacattgtggcaggttatgcttgtcaggtgagcttctctcctgatgggaggtttgtgatgtcaggagacggtgaaggtagttgctggttctgggactggaaaagctgcaggagattcaagacattgaagtgccacaatggagtttgcattggatgtgagtggcatccgttggagactagcaaggttgcaacgtgtggatgggatggtgtcataaaatactgggattaaagatttggcaatttagacagaaacgttgctcgagat

SEQ ID NO: 4511 - DNA, 639 bp, Triticum aestivum
aatgggctgatattgttaacgcccatgtaattcctgggcctggaattgttgatggcttgaagcttaagggtttaccaaaagggagagggcttcttctgcttgctgaaatgagctcggctggcaaccttgctcaaggagattacactgcagcagctgtaaagattgccgagcaacattctgattttgtgattggatttatatcagtaaatcccgcatcttggtctgtggcaccatcaagcccagcgtttatccatgccacccctggagtgcagatggtttctggaggagatgctcttgggcaacagtacacaactcctttttctgtgataaacgacagaggcagcgacataatcattgtgggccgcgggatcatcaaggcgagcgaccccgagcagacggcgagggagtaccgcgtccaagggtggcaggcgtacctgtccagcttgtgaggaaggctgctgctcaaacgcaaacgcctctctcagtgtaaacccaaacgaaatgcgctggcgttcgagccatggatcgatcaatgtaataagagtgcctcctgtcggcgctgagtgatttcccccttgtgcctggtgtcggcggcacgcgtcgttttggggaaataacttcgaaatcgcggtaatggaa

SEQ ID NO: 4512 - DNA, 707 bp, Triticum aestivum
ggacattggtaacacagtaactatgcaagatgaaggtaggaatattccgcatattagaatgggctgatattgttaatgcccatgtaattcctgggcctggaattgttgatggtttgaagcttaagggtttaccgaaaggaagagggctacttttgcttgctgaaatgagctcagctggcaaccttgctcaaggagattacactgcagcagctgtaaagattgctgagcaacattctgattttgtgattggatttatatcagtaaatcccgcatcgtggtctgtggcaccatcaagcccagcgtttatccatgccacccctggagtgcagatggtttctggaggagatgctcttgggcaacagtacaccactccttattctgtgataaacgacagaggcagcgatataatcattgtggggcgcgggatcatcaaggcgagcgaccccgagcagacggccagggagtaccgcatccaagggtggcaggcgtacctgtcgagcttgtgaggaggaagctgctgcccaaacgcctctctcagtgtaaaacccaaacgaaatgagctggcgttcgtgccatcgaccgatcaatgtaataagagcgcctcctgtcggcgccgagtgatcttcccccttgtgcctggtgtcgcgtcgttttggggaaataatttcgacattgcggtaatagaaaccagaacgttccaatgagca

SEQ ID NO: 4513 - DNA, 747 bp, Triticum aestivum
gctcgattgctgagaagcgcaactttttgatcttcgaagaccgcaagtttgctagcattggcaacacagtaactatgcaatatgaaggaggaatattccgcatattggaatgggctgatattgttaacgcccatgtaattcctgggcctggaattgttgatggcttgaagcttaagggtttaccgaaaggaagagggctacttttactcgctgaaatgagctcagctggtaaccttgctcaaggagattacactgcagcagctgtaaagattgccgagcaacattctgattttgtgattggatttatatcagtaaatcccgcatcgtggtctgtggcaccatcaagcccagcgttcatccatgccacccctggagtgcagatggtttctggaggagatgctcttgggcaacagtacaccactccttattctgtgataaacgacagaggcagcgatataatcattgtggggcgcgggatcatcaaggcgagcgaccccgagcagacggccagggagtaccgcgtccaagggtggcaggcgtacctgtccagcttgtgaggaaagctgctgctcagacgcctctctcggtgtaaaacccaaatgaaatgcgctggtgttcgtgccatcgaccgaccgatcaatgtaataagagcgcctcctgtcggcgccgagtgatttccccccttgtgcctggtgtcggcggcacgcgtcgtcttgggggaaataacttcgaaatcgcggtaataga

SEQ ID NO: 4514 - DNA, 680 bp, Triticum aestivum
caggaggtcggcgaccagtgggcgctgcgcggtgtcacattacgcccctggcatcctccactggtggatggaccagagctggctgcccacctccaccgtcgtggccggcaccacgccgctccccaacaagcgcgacgccgagatccgcgccaagctcaaggccgacggcacgttccagcagaagatggaactggcgacacagcagggcatccacgagtcgtactaccgcgacatgatggtgatgttcggcaagtgggagttcgacccgatgagcctgccgaagccgccttgccccgtccacatctggcagggcgacgaggacggtctggtgcccgtggtgctgcagaggcacatcgccagccggctcagctgggtgaactaccatgagctccccgcgaccgggcatttcctgtcgccggtccctgggctaggtgacaccgttcttcagacccttttcggcaatgctaagcaatgatcaggaacagcaatagtagctctgaacatactacgttgctgaagtatagggttcttccgatgcattgttttattctaaggtggtcaggtaatcgctgctgattagcgacgatgttataggtgaaatggtggtgtaacatcaagtgttttttgtggcggaaattgcgcggccaggatgtgcgcgcaaaatatgtaattgaaccttg

SEQ ID NO: 4515 - DNA, 718 bp, Triticum aestivum
gggcgctgcggtgtgtcacattacgtcccctggcatcctccactggtggatggatcagactgctgcccacctccaccgtcgtggccggcaccacgccgctccccaataagcgcgacgccgagatccgcgccaagctcaaggccgatggcacattccagcagaagatggaactggcaacacagcagggcatccacgagtcgtactaccgcgacatgatggtgatgttcggcaagtgggagttcgacccgatgagcctgccgaagccgccttgccccgtgcacatctggcagggcgacgaggacggcctggtgcccgtggtgctgcagaggcacatcgtcagccggctcagctgggtgaactaccatgagctccccgcgaccgggcatttcctgtcgccggtccccgggctaggtgacaccgttctccagacccttttcggcaatgctaagcaatgatcagcagcaacaacagcaacagcagctctgaacatactacgttgctgaagtatagcgttcttcgggtgcattgttttattctaaggtggtcaggttatcgctgattagcgacgatgttataggtgaaatggtggtgtaacatcaagtgttttttgtggtggaaatcgcgcagccaggatgtgcgcgcaaaatatgtaattgaaccttggaaacgagaaagtagtggaactactataccatgatgatcttaccttttactccgt

SEQ ID NO: 4516 - DNA, 693 bp, Triticum aestivum
catcgtggacaccgtcatggcacgctgcgacgagatctttcaggctcaagggcgccgcggccaaggccgacgccttccgcgtcctgtcggggacgtggacgacccccgtcgagaggtgcttcctctggctcggcggcttccggccatccgagcttctcaagctgctcgcgagcaggctggagcccctcaccgagaagcagctcgacagtatcgatgtcctgcggcgttcctccctgcaagccgaagaagcactctcgagagagatggaagcgctgcgacagtcggtcaccgaaaccatcgcggcggcaggatcgtcgtcccagagctgctccgacgatgattgcacgggccaaatggcggcggcggtgggaaagcttggcgccatggaaggcctcctgcggcaggctgatgatctgcgactgcggattctcgaggaaacgcggcgggtactgaccatccgtcagtgcgcacgagcggtgctcgtggtcagcgactacttctcccggatgcgcgccctgagttctctctggatcgcacgtccgacgaccggagtgaactgagtttccacagtcggacatattattattattcgagaaaagcaaaagagaacgtagtactatggactgcatatgaactgaaataattagtgaacaatctctatctctatctttatccctactacttccacatggg

SEQ ID NO: 4517 - DNA, 533 bp, Triticum aestivum
  misc_feature (183)..(183): n = any nucleotide
gagatccccacgccctatatgcaagtcgtgatttgggcttatcaaaggttaaatgccagacactaatctccgtggggtgcgagggacacttccctggatggctcctgagctgttaaatggcacgcagtaaccttgtttctgaaaaggtcgacgtcttctcattcggaatcgtgatgtgggacntgcttaccggtgaagagccttatgctgacctgcattatggcgccatcataggtgggatcgtgaacgacaccctacggccgctggtgcccgagtcgtgcgacccccagtggagatcgctgatggagcagtgctggtcagccgagccgatggagcggccgagcttcacggaggtcgtcaagaggctacgggctatggcgacctcccccaccaagacgctgccgcagaagtagactgcccttagctccgtacatgagcaagggaaaatatagagaaggacgcggcgacgctgctcacaataggatagagctggtgggggtttgcctgacacttcatgtggtgcttttagacac

SEQ ID NO: 4518 - DNA, 711 bp, Triticum aestivum
acttcgacttgaagagtgataatctgctcgtcattctaagagatccccaccgccctatatgccaagtcggtgatttgggcttatcacaaggttaaatgccagaccctgatctctggtggagtgccgaggaacacttccctggatggctcctgagctgttaaatggcagcagtaaccttgtttctgaaaaggttgacgtcttctcattcggaatcgtgatgtgggagctgcttaccggtgaagagccttacgccgacctgcattacggcgccatcataggtgggatcgtgaacaacaccctgcggcctctggtgcccgagtcgtgcgacccccagtggagatcgctgatggagcagtgctggtcggccgagccgacggagcggccgagcttcacggaggtcgtcaagaggctacgggccatggcgacctcccccaccaaggcgccgccgcagaagtagactgcccttagctctgtacatgagcaagggaaaatatagaggaggccgcggcaatgctgctcacaataggatagagctggtggggtttgcctgacgcttcatgtggtgcttttagacactgatgatgatccccgcatgaaaatgtaagagcatgtacaggaaggtgccgtggcatggttggtgaatgtgttatgtaccggctcctggggtgttccgggacttgtttcctgcgcgtgatcgctgtgcataagcct

SEQ ID NO: 4519 - DNA, 673 bp, Triticum aestivum
tatctctgtgggtcgaggacacttcccttggatggctcctgagctgttaaatgccagcagtaaccttgtttctgaaaaggtcgatgtcttctcatttcggaatagtgatgtgggaacttcttactggtgaagagccttatgctgacttgcattacggcgccatcataggtgggatcgtgaacaacaccctgcggcctctggtgcccgagtcatgcgacccccagtggagatcgctgatggagcagtgctggtcggccgagccgacggagcggccgagcttcacggaggtcgtcaagaggctacgggccatggcgacctcccccaccaaggcgccgccgcagaagtaggctgcccttaggctctgtacatgagtaaggtgatgaaatatggagaagaacgcggggacgctgcttacataggacagtggagctggtggggtttgcctgacgcttcatgtggtgctgttagaaactgatgatgatgatgaaatgtaagagcatgtacaggaaggtgccgtggcaagggttgctgaatgtgttacgtaccggctcctgggtgttccggaacttgtttcctgcgcgtgatcgctgtgcagaagccttgctggaacaaatgcagaatgcagtctgtggcctgcgtcctcttgctagcttggatgcgtgagcttgcctgt

SEQ ID NO: 4520 - DNA, 612 bp, Triticum aestivum
agctcctgggcctatgaatacaaggacggccaccgagtaaaaaaatacagaggtatgggctccctcgaagccatgacaaaggggagcgatgcaaggtatcttggtgatactctgaagcttaaagttgcccagggagttgttggagcggtagctgacaaaggttctgttctgaggtttattccgtatacaatgcaagctgttaagcaaggattccaagatcttggtgcatcctctttgcagtcagctcatgatcttttacgagcggagactcttagattagaggtgaggaccggcgccgctcaagtggagggagggatccacgggctggtgtcgtacgagaagaaatcattctagcccccatctttgatcgaggacgggcatactggttctctgcgtgtgttccatccaaggttggcagcgggtcacctgatagtgtttgagagcagcctcccagcccgtctgtgggggccgttcgctcccctatcgatctaccactaccactaggatggttgtaacatcatcatctttccaccatggccatggttgaaaacactggacatcgtaagaaatggctgtaacaataaaagcgatgtttccgtttgctactttgcg

SEQ ID NO: 4521 - DNA, 673 bp, Triticum aestivum
tcatactctggcatatttgtgaagcttttgtcactgggggcttcaactgttatgatgggcagtttcttggctggcagccatgaggctcctggggcctatgaatacaaggacggccatcgagtgaaaaaatacagaggcatgggctccctcgaagccatgacaaaggggagcgatgcaaggtatcttggtgatactctgaagcttaaagttgcccagggagttgttggagcggtagctgacaaaggttctgttctgaggtttattccgtatacaatgcaagctgttaagcaaggattccaagatcttggtgcatcctctttgcagtcagctcatgatcttttacgagcggagactcttagattagaggtgaggaccggcgccgctcaagtggagggagggatccacgggctggtgtcgtacgagaagaaatcgttctagccccatctttgatcgaggaccggcgtaccggttctccgcgtgttccatccaaggttggcagcgggtcacctgatagtgcttgagagcagcctcccagctcgtccgtgtgggtggggctatcgatctaccactaccgctaggatggttgtaacatcatcatctttccaccatggccatggttgaaaacttttggacatcgtaatggctgtaacaataaaagtgatgtttccgtttg

SEQ ID NO: 4522 - DNA, 724 bp, Triticum aestivum
  misc_feature (32)..(32): n = any nucleotide
cgtccgctgatggtggtatttcaactctggcnaattgtgaaggctttgtcactggggcacaactgtcatgatgggcagtttcttggctggcagccatgaggctcctggggcctatgaatacaaggacggccaccgagtaaaaaaatacagaggtatgggctccctcgaagccatgacaaaggggagcgatgcaaggtatcttggtgatactctgaagcttaaagttgcccagggagttgttggggcggtagctgacaaaggttctgttctgaggtttattccgtatacaatgcaagctgttaagcaaggattccaagatcttggtgcatcctctttgcagtcagctcatgatcttttacgagcggagactcttagattagaggtgaggacgggcgccgctcaggtggagggagggatccacgggctggtgtcctacgagaagaaatcgttctagccccagctttaatcgaggccgtcgtaccggtgtcctacgtgttccatccaaggttggcagggggtcacctgatagtgtttgagagcagcctcccagctcgtccgcgtgggcgtggctgttccccctatcgatctcccgctaggatggttgtaacatcatcatctttccaccatcgccatggttgaaaactttggacatcgtaagaaatggctgtaacaataaaagggatgtttccgtttgctacactgcgagtggaaaggaagaacagcc

SEQ ID NO: 4523 - DNA, 697 bp, Triticum aestivum
cgcccactccgacggggacgtgcttctgcactgcgtggtggacgccattctcggcgccctggggctgccggacatcgggcagatcttcccggacaccgaccccccggtggaagggtgcagagtcctgcgtgttcatgagggaagctgtaaagctaatgcatcaagcaggctatgagctggggaaccttgatgctacactgatcttgcaaaaccaaaaattagcccgttcaaggagactatccgatctaacttgtgtgaactactcggggcggatccatctgttgtcaatctcaaggccaagacacatgagaaagtcgacagtctaggagaaaacaggagtatagctgctcataccgtagttctcctgatgcggaagtagagtgttagaagtatactacataatacaggaattgtattgtattgtagtgttgctgtacaagaggttactacactatccctgtggtatagtcaatacggaagcttcaggggaaagtagtaaagctgagtacacaagagaaatgtgtatccagcctgtgtctcctgttattgttccaaaattgtattcttgttttgcagggtactagatatcaatcattttggaagttcttgttattttcttaccgaccttaagaaccattcacaaattatacagcatatactagtatgaggattttaaaagtgaaaaaaaataaaataa

SEQ ID NO: 4524 - DNA, 693 bp, Triticum aestivum
ccggcaagcaggacacggggacggggggagctgtcgccgggaggagatggagatgacgggaccgcaccccgtcaccaacgcgtcgccatacaccgtcgtggagaccatgtcgctggccaaggcgctcgtcctcttccgcgaggtcggcctgcgccacctcctcgtcgtgcccaaggcctgcgacaggtcgccggtggtggggatcctgacgaggcacgacttcatgccggagcacatcctggggctgcacccggtgctgctgggcggcaagtggaagcggctccggtggcacaaggccgccgtcgccaagtacttccgcgacctcatcgtgcggctcgccaactgcggctgaagcacaaaacacacatcctagtgtatactacctgcattctgctggcaggatgtttgggtgaggatcaatttttgcgcgcctgtgaagaaataattccaaaaaacactgtttcttcttcttattattatcttgattcattacttgtaagtatatttgctcccagaaatagagtggtggtccgtgtatatccgttgggtctgccacgtcttgcactgctgttctttgtgtacattattaacgacggggagatgttctttccggaacttaattattgcggaacatgtgacctgaacgtgtcagctcatggcccgttgtcagctctagttataagaaatggtcgc

SEQ ID NO: 4525 - DNA, 778 bp, Triticum aestivum
gccgaaccgccggcctcccgttcgcgtggccacggcttcgacctccaccgcctcgaccggcctcccgctcatcatcgcggcatcagcatcccccacgaccgcgctgcgacgcccactccgacggggacgtgcttctgcactgcgtggtgacgcgattctcggcgccctggggctgccggacatcgggcagatcttcccggacaccgacccccggtggaagggcgcggactcctgcgtgttcatgagggaggctgtaaagctaatgcatcaagcaggctatgagctggggaaccttgatgctacactgatcttgcaaaaaccaaaaattagcccgttcaaggagactatccgatctaacttgtgtgaactacttggggcggatccatctgttgtcaatatcaaggccaagacgcatgagaaagtcgacagtctaggagaaaacaggagtatagctgctcataccgtagttctcctgatgcggaagtagagtattagaggtatactacataatacaggaattgtattgtattgtagtgttgctgtacaagaggtgttactacactatccctgtggtctagtcaatatggaagcttcagggaaagtagtaaagctgagtacaatgaagagaaatgtgtatccagcttgtgtctcattttattgctccaaaattgtattcttgtcttgcatgggtgctagatagcaatcattttggaagttcttgttattttcttccggaccttaagaaccattcacaaattatatctgcagtatactggta

SEQ ID NO: 4526 - DNA, 641 bp, Triticum aestivum
tcccgctcattcatcgggcggcatctagcatcccccacgaccgcggctgcgacgcccactccgacggggacgtgcttctgcactgcgtggtggacgcgattcctcggcgccctggggctgtccggacatcgggcagatcttcccggacaccgacccccggtggaagggcgcggagtcctgcgtgttcatgagggaagctgtaaagctaatgcatcaagcaggctatgagctggggaaccttgatgctacattgatcttgcaaaaaccaaaaattagcccattcaaggagactatccgatctaacttgtgtgaactactcggggcggatccatctgttgtcaatctcaaggccaagacgcatgagaaagtcgacagtctaggagaaaacaggagtatagctgctcataccgtagttctcctgatgcgcaagtagagcattagaagtatactacataatacaggaattgtattgtattgtagtgttactgtacaagaagaaaaatgtgtatccagcttgtttctccttttattgttccaaaattgtattcttgtcttgcagggtatactaggtagcaataattttggaagttcttattgttttcttccggaccttaaggaccattcacaattatacagcatat

SEQ ID NO: 4527 - DNA, 554 bp, Triticum aestivum
cgggagttcctgccggcgcaggagcggtaccccaaggagtacagcatcgcggcgaggttcgaggcgcaggacttcgacaagcgcggctccggcaagcaggacacggtggacggcgtggagctgtcgccggaggagatggggatgtacgtggacctgcacccgttcaccaacgcgtcgccatacaccgtcgtggagaccatgtcgctggccaaggcgctcatcctcttccgcgaggtcggcctccgccacctcctcgtcgtgcccaaggcctgcgataggtcgccggtggtggggatcctgacgaggcacgacttcatgccggagcacatcctggggctgcacccggtgctgctcggcggcaagtggaagcggctccggtggcacaaggccgccgtcgccaagtacttccgcgacctcatcgtgcggctcgccaactgcggctgaagcatcaaacacacatcctagtagtgtatactacctgcattctgctggcagaatgttggggcgaggatcaatttttgcgcgcctgtgaaataataatttcaaaaacactg

SEQ ID NO: 4528 - DNA, 747 bp, Triticum aestivum
cgccccgtgcttacgcctcgtgctcagggcgcaccctcctcgtgctcctcaggaagcggggagttcctgccggcgcaggagcggtaccccaaggagtacagcatcgcggcgaggttcgaggcgcaggacttcgacaagcgcggctccggcaaagcaggacacggtggacggcgtggagctgtcgccggaggagatggagatgtacgtggacctgcacccgttcaccaacgcctcgccatacaccgtcgtggagaccatgtcgctggccaaggcgctcatcctcttccgcgaggtcggcctccgccacctcctcgtcgtgcccaaggcctgcgacaggtcgccggtggtggggatcctgacgaggcacgacttcatgccggagcacatcctggggctgcacccggtgctgctcggcggcaagtggaagcggctccggtggcacaaggccgccgtcgccaagtacttccgcgacctcatcgtgcggctcgccaactgcggctgaagcatacaacaaacgtacgtacatattacctgcattctgctggcagaatgttggagtgaggatcaatttttgcgcgcctgtgaagaaataattccaaaaaacactgttttctcttcttattatcttgattcattacttgtaagtatattagctccaaaaaacagagtggtggtccgtgtatatccgttggatctgccacgtcttgcactgctgttccttgtgtacattattaacgacgggaagat

SEQ ID NO: 4529 - DNA, 615 bp, Triticum aestivum
  misc_feature (384)..(411): n = any nucleotide
catcgaggcggcgaactggcgacgcgcacaccttcatcagctcgctgccggaggggtaccagaccaagttcggggagcccggcgtgcagctgtcgggcgggcagaagcagcatcgccatcgcgcgcgccatcgtcaaggacccggccatcctgctcctggacgaggcgacgagcgcgctggacgtggagtcggagcgtgtggtgcagcaggcgctggacagggtgatgaagaaccggacaacagtgatggtggcgcaccggctgtcgacgatcaagaacgccgacgtcatctcggtgatccaggacggcaagatcatcgagcagggggatcaccagcacctgatcgagaacaagaatggcgcctaccacaagctcgtcaacttnnnnnnnnnnnnnnnnnnnnnnnnnnnnggggggcagagctcatgagctccctggggaagaaccatgtgcttctgtatccagctgggcttccctcaagttcatcgaatgtaaaagctgtgctctacattttctttttcttaaagtgtgtgttcaccattatacagggagaagtgctctcatgttgatttctttgtagcagtagatagtaattgcaattttcatttaggatat

SEQ ID NO: 4530 - DNA, 664 bp, Triticum aestivum
  misc_feature (394)..(424): n = any nucleotide
gaggtcatcgaggcggcgaagctggcgtacgcgcacaccttcatcagctcactgccggaggggtaccagaccaaggtcggggagcgtcggcgtgcagctgtcgggtgggcagaagcagcgcatcgccatcgcacgcgccatcgtcaaggacccggccatcctgctcctggacgaggcaacgagcgcgctggacatggagtcggagcgcgtggtgcagcaggctctggacagggtgatgaagaaccggaccactgtgatggtggcgcaccggctgtcaacgatcaagaacgccgacgtcatctcggtgatccaggacggcaagatcatcgagcagggggatcaccagcacctcatcgaaaacaagaatggtgcctaccacaagctcgtcaacttnnnnnnnnnnnnnnnnnnnnnnnnnnnnnnngagggccagagctcatgagctccctggagaagaacgatgtgcttctgtatccagccgtctctttcatggcttccctcaagtacatcgaatgtaaaagctgtgctctacattttctttttcttaaagtgcgtgttcaccattatacagggagaagtgctctgatgttgatttctttgtagcagtagatagtaataacaagtttcatttaggatatatatatatatgcactgttgctgggtg

SEQ ID NO: 4531 - DNA, 561 bp, Triticum aestivum
agaagatctctcagatagaaaccaagatagagaaaatggagatggataagaagacgaaggaggatttgaagacggtggcattagggacatcaaagatcaactaccttgatcccagaattacggtagcatggtgcaaaacccatgaagtccctattgagaagattttcagcaagacgattcttgcgaagtttggatgggcaatggatgtcgagccggatttcagattctaagagtattggcttccgggtgagccaatggccccttggtaaattcgattcagcttccaggccttctcccggacccctaactgcaactagtagtaaaggaagagctcggtgtttgttttttaagtccccctgctcctggaagaaggaagcacccagcattctctttgtaggctctttttttttctttctacccatcttctcttctgtacttgctatggcccaattgcctaaagtcgtgttttgcatttcatttgggctgacggattttagcttgttgagaactgatgacattcatttatataccggagtcatctaaatatagataccatcagag

SEQ ID NO: 4532 - DNA, 577 bp, Triticum aestivum
atgggaacccaaagagagctttggcacctgaagcgattgagaagaagatctctcagatagaaaccaaggtagagcaaatggagatggataagaagacgcaagaggatttgaagacggtagcattagggacatcaaagatcaactaccttgaccctagaattacggtagcatggtgcaaaacccatgaagtccctattgagaagattttcagcaagacaattcttgcaaagtttggatgggcaatggacgtcgagccggatttcagattctaagagtattggcatccgggtgagccaatggccccttggtaaattcgattcagcttccaggccttctcccggacccctaactgcaactagtagtaaaggaagagctcggtgtttgtttttgaagtctccctgctcctggaagatggaagcacccggcattttctttgtaggcttttttttctctacccatcctctcttctgtacttgctatggcccaattgcctaaagtcgtgtttgcatttgggccgatgaattttagcttgttgagaactgatggacattcattttataccgcatcaatcacaaat

SEQ ID NO: 4533 - DNA, 705 bp, Triticum aestivum
  misc_feature (575)..(591): n = any nucleotide
ctgtccatgttgtgaatgtcataaatggcgtacagtttcacgaaagatgaatctgagacattcgtgagaacttcactgaagacccatggttctcagtaaaagacctgagtgctcgtgtgaagaccctccagacattgagtatgacagcagccgcatatgggtcatcgacaagcccaacataccaagcctccgcccaagaccgagagacttgtgatcatgagaggtgatctgtctaaaatggacatctactatgtcctgccaaacgggaagcgtgcaaggggcatcggggacgtgcagaagttccttgacacaaacccagagtacaaggaccgcatatcagctgaaagcttcagttttacggtgcccaagattgttgaggagaccgtttcacagagctctttgtggaagactaaaaaggctaaaaagcaggacaagataaatgcttcaagcagcaagaaggacaaggcaaatgcttcaagcagtgagaactagccatgtcagcaaatgcaaaactgtcgcctgcctgcttggatgatcctacctcatctaccttgaagttagtcatcaagtcggtnnnnnnnnnnnnnnnnngcgatgttactctgagcgctccaatgcactgaatctcttcctttttatgcatgagtttctggtaaaattctgagatgctcgagaagggctgtagcttgttctcttctaataaaa

SEQ ID NO: 4534 - DNA, 728 bp, Triticum aestivum
tgcaacggatcattggccttgtatgctgtccagtgttgtgaatgtcataaatggcgtacagtttcaacgaaagatgaatttgagaccacttcgtgagaacttcactgaagacccatggttctgcagtaaaaaacctgagtgctcgtgtgaagaccctccagacattgagtacgacagcagccgcatctgggtcatcgacaagcccaacataccaaagcctccgcccaagaccgagagacttgtgatcatgagaggtgatctgtctaaaatggacatctactatgtcctgccaaacgggaagcgtgcaaggggcatcggggacgtgcagaagttcctcgacacaaacccagagtacaaagaccgcatatcagctgaaagcttcagttttacggtgcccaagattgttgaggagaccgtttcgcagagctctttgtggaagactaaaaaggctaaaaagcaggacaagataaatgcttcaagcagcaagaaggacaaggcaaatgcttcaagcagcgagaactagccatggcagcaaatgcaaaactgtcgcctgttgcttggatgatcctacctcatctaccttgaagttagtcatcaagtcggttctctctctctgcgatgttactctgagcgctccaatgcactgaatctcttcgtttttatgcatgagtttctggtaaaattctgagatgctcgagaagggctgtagctttttctcttctaataaa

SEQ ID NO: 4535 - DNA, 703 bp, Triticum aestivum
tggttctgcagtaaaagacctgagtgctcgtgtgaagaccctccagacattgagtacgacagcagccgcatctgggtcatcgacaagcccaacataccaaagcctccgcccaagaccgagagacttgtgatcatgagaggtgatctgtctaaaatggacatctactatgtcctgccaaacgggaagcgtgcaaggggcatcggggacgtgcagaagttcctcgacacaaacccagagtacaaagaccgcatatcagctgaaagcttcagttttacggtgcccaagatcgttgaggagaccgtttcgcagagctctttgtggaagactaaaaaggctaaaaagcaggacaagataaatgcttcaagcagcaagaaggacaaggcaaatgcttcaagcagcgagaactagccatggcagcaaatgcaaaactgtcgcctgctgcttggatgatcctacctcatctaccttgaagttagtcatcaagtcgggtctctctctctgcgatgttactctgagcgctccaatgcactgaatctcttcgtttttatgcacgagtttctggtaaaattctgagatgctcgagaagggctgtagctttctcttctaataaaaagatctagttacagatgtccttgagtttaccatccgccgtgatacattgttttaccagatggccatatgcgtagagatctcattagaaagc

SEQ ID NO: 4536 - DNA, 1233 bp, Triticum aestivum
tgtctggaatgtgacaacccagtggaccaccacctatctgatgctcttggctgccttggattataggcaagctttcattacactagaaacagttgatgacaactacatatgaagcaccatcagctgaggactggaaaaaaaattgaggctgccttgcaattacttgaggctgctctatgactcggctcatagcatcatggcagcaggaaacccaacctcaaacattttcttccatgaagcttggaaactgcagctagagctgggaaatggttcagcacacgaagatccaattttcagtagcatcgccaaagacatgtatgagaggtttgacaaatactggaaagattgcaaccttgtgttagctgttgctgttgtgatggatccacgttttaagatgaagcttgttgagttcagttactcaaagatttacggcgttgaggctgcgaagtatgttaaggtggtaaatgattcggtgcatgaccttttcaaggattatgtcgcacagccgctccccttaacaccgacctatgctgaacaagggaaaactgataatgctactgccaatgggaacaacacccaagcaactcaaccttcagctggtgatggccttcaagactttgatatatatctttccgagattgccacaacccagccctcaaaatctgagctagagcagtacctggacgagtctctcactcctcgcatccaagagtttgacattctcaactggtggaagctcaacatgcagaagtatccgacgctctcaaagatggcgcgggacatcttggccatcccggtgtccatggtgaccggcggaacctctatattttccgcaggaacagggtgccacgtgctcgacgactacagaagctcgctccgtccggagatcgtggaagcgctcgtctgtgcgaaggactggcttctgaattcgaccgccgcgccggaggcggcgccgggctctgggcttctcaagatggactaggctcgcttcctttgctgaagcatgcatatatgtcttctggcgcctgtgagtggtctttttaactgtagtcgtgttttaggcagagtttgtggactggctgcgatcgatgatttcattggatctgtcctagaatgtaatttgccgtgtagaactctgttaactcctccatgctgttatgtccaccccttccttgtgttgtaatatgtgaccagagatgttatctgacgttgtttgggatgtgtatgtgcaag

SEQ ID NO: 4537 - DNA, 1079 bp, Triticum aestivum
gcccgaaaccctagctctctgctttcatccccgccaccgtccccatggcgccagggctcaaacgcttcaccgacgtcgcggcagacggcacgccccgcctcgacgacgccgccggcgaggagctcgtgtgcgtggagcgcgccgcctcggtcgccctcggcagccgcgcgccggagcccccgggaaccctcttcatcaccaccaggagggtgatttggctcagcggggcggagaagggcaaaggatacgcggtgggcttcctggacatcactctccacgcagtgtcgcgcgacccggaggcgtacccctcgccgtgcctctacactcagattgaagccgaagctgactctgatgaagaggatggtgattttgactctgaagcaggtggtgactcacagctaccaaaaatctctgagatgcgtattatattggcagatgctgcccaactagattcactttttaatgccttctgccattgtgctgaactgaaccctgatcctactgctgaagaaaatgaagacagtgacttgttccatggtggggatatgaccaatggtggttggattcatggcgatgaagatgaacacatggttgatggaatcgaccctgagttttttattcccaacccgataggtcaaaatggtggagatgacctcagttcttcagtacttgagcttcaaatcaatgaccagcgtttcgaggatgcggatgaagaggaggcccatgaaaatgggcattagaagcagatatatgctcgttttacttatcatgatcctcgtgaggaccatgtcattagtttggttgaagattgctgtagatgcagcttggttcgcctcatgctgttgtgtcccacactttccttttgtcctttaatagacgctgctataggatcgaggactctgagggcaaccgtgtagagttgcgtcgatggtaacttttatgggagaaggtcttgcttactggtcaagaatgtaacatgtagagcttggtggagaatccgattgatggatttcaataacttttgatctaacaaatggaagggggagatgggggaaagtagtagtaactcttttcgaagg

SEQ ID NO: 4538 - DNA, 666 bp, Triticum aestivum
tggaccgggtcggcgctgcacgccgccgtcaacttcgggcagtacccgtacgcaggttaccacccctacaagccgtcagcgagccgccgtccgatgccagagccggacaccgaggagtacgccttgctggcccgcgacccggaaaaggtgttcatccgcaccatcaccaaccaaatgcaggccatcattggcatttctctgctggagatcctgtccaagcattcctccgatgagatttacctcgggcagcgtgacacgccggagtggacgtcggatgccaaggcactggaggcgttcaagcggttcggcacgaggctggagggcatcgagagccaggtggtggccttgaacggaaacccccagctcaagaaccgcaatggaccagcccagttcccctacatgctgctctacccctacacctccgaccacacgggcaaggccgagggcctcacggccaggggcatccccaacagcatctccatctgatgagatatttggaggaaggtcgttgctcgccagcatgcaaaatgttggggtgtgtgcttctaggatcatttgcttgaataatctagtacaccggtgctcatttgacacccagtgttatgtgcgtgggtagccactggtcagccactagctcaactggatgttccatgtaatttttccata

SEQ ID NO: 4539 - DNA, 700 bp, Triticum aestivum
ggctgcgccaccatcatctggaccgggtcggcgctgcatgccgccgtaaacttcggggcagtacccgtacgcaggtaccaccccaacaagccgtcagcgagccgtcgtccgatgcctgagccggacagcgaggagtactcactgctggcccgcgacccggaaaaggtgttccatccgcaccatcaccaaccaaatgcaggccatcattggcatttctctgctggagatcctatccaagcattcctccgatgagatttacctcgggcagcgtgacacgccggagtggacgtcagatgccaaggcactggaggcgttcaagcggttcggcacgaggctggagggcatcgagagccaggtggtggccttgaacggaaacccccagctcaagaaccgcaacgggccggcccagtttccgtatatgctgctctaccccaacacctccgaccacacgggtgaggccgaggggctcacggccaggggcatccccaacagcatctccatctaatgagatatttggaggagcattgttgctcgccagcatgcaaagatgttggggtgcgtgcttcgaggatcattgcttcaataatctagtacaccagtgctcatttgacacccaagtgttatgtgcgtgggtagtcacatggtcaatgtatgttccatgtaattttccccttccaaattatatattaataaagtgatg

SEQ ID NO: 4540 - DNA, 793 bp, Triticum aestivum
gcgtggtggaaggaggtacgcgaggtcggccacggcgatctcaaggacgcggcatggtggcccaagatgatgacggtggcggagctggtcaaggcctgcgccaccatcatctggaccgggtccgcgctgcacgccgccgtaaacttcgggcagtacccctacgcaggttaccaccccaacaagccgtcagcgagccgtcgtccgatgccggagccggacaccgaggagtacgccttgctggcccgcgacccagaaaaggtgttcatccacaccatcaccaaccaggtgcagtccatcattggcatttccctgctggagatcctgtccaagcactcctccgacgagatttatctcgggcagcgtgacacgccggagtggacctcggatgccaaggcgctggaggcgttcaagcggttcggcacaaggctggaaggcatcgagagccaggtggtggccttgaacggaaacccccagctcaagaaccgcaatggaccagcccaattcccctacatgttgctctaccccaacacctccgaccacacgggcaaggccgaggggctcacggccaggggcatccccaacagcatctccatctgatgagatattcggagaaaggtcggttctcgccagcacgcaaaaatgttagggtgcgtgcttgcaacaacattgcttaaataatccagtacattagtgctcatttgacacccaagtgttatgtgcatgggtagccactggccaatgtatcatcttccatgtaattttcccttccaaattatatattaataaagtgatg

SEQ ID NO: 4541 - DNA, 881 bp, Triticum aestivum
gaaaagccgacggcagaaggaacgcgaagcaatcacccccttctccccccgttgcttccccgcgccgaactcgaatcctccccctcgcgccgcacccgagggctccgccggagatcggtcgaggggacgcggccctagctggagatggtcgccgccgtggtgaactacccgctcgtcgcggggctcctcgccttcgcggtcgcgcagtccgccaagttcttcaccacctggtataaagagaaacgttgggatgccaggcaatttatagcttctggagggatgccatcatcacattcagccacagtgacagcacttgcagtgtctgttggaatccaagaaggctttcgtagcgccacatttgcaacttcagtgatacttgcatgtgtggtgatgcatgatgcttttggtgttcggttacacgctggaaaacaagcagaggtgttaaaccaaattgtctacgagctgcctatagagcatccgctggcagagacaaagccattgcgtgagattcttgggcacacagtccctcaggtggtggctggttgcatccttggaatcctcacggctgtggtcatgctcttagctctggggagaggcaatatttgatcatctaatatcgcatcgccgatcttgtaaagcatacaaaagaagctcatctttgatgtaatgtgtaaaagtggcctgtccatgctgctacaaagtcttaactgatatagatctgcgctgtaggattgtaggtcgtagcttcagttggtgctgtaaatctgagatgtttgctgtcgatcagaacctcctcatgttgaatgtttgctgtacaactagcagtgatatgtagcttgagaacgtgatggttctgaatagttgataccacgtcataagct

SEQ ID NO: 4542 - DNA, 1242 bp, Triticum aestivum
  misc_feature (270)..(270): n = any nucleotide
ctccagccgcccatgcccacgccctacgtcgagcaccagaaggccgtcaccatccgcaacgacgtcaacctcaagaaggagacgctccggattgagcctgatgaaggctgtcccggttgcttcctcgtcgccttcaccttcgatgccaccgtcgctggaagcatgactgtctacttctttgcaaaggaagagctcaattgcaatctaacagcaatgaagccagacttgattaagcctgttactgttagcttcaaagagggtcttggccanaagtttaggcaaccttctgggacgggaattgacttctcagcgtttgaggactctgagttgttgaaacaggggggaatggaaatatatccacttgcagttaaagctgaaacaacactgtctgctgatcaaccatcggagggggaagaccagaagccaaaaactccaaactcgcagatcacacaggctgtgtttgaaaagaaagaaagtggcgactatcaagtacgagttgttagtcagatcctttgggtgaatggcaccaggtatgaattgcaggaaatatatgggataggaaactctgtggaaggggacactgatgcaaatgatcctgggaaagaatgtgtcatatgcctctcagaacctagggatactactgtccttccatgtaggcatatgtgtatgtgcagcgagtgcgccaaggtcttgaggtaccagaccaccaggtgccccatctgccgtcagccggtcgagcggctgctggagatcaaagtgaacaacaaagctgaagagccgccccagcagacgtcccagtcgcctccgctacctccaccccctgctctgcatcaggaagagatgtagctacagcctatcacgaacagcgtaaaaacactatatgcttctagattgcggtcttcgggccttctccccctgcagggtgctcacttcgtctgagcacaccgggtgtaactgttaaactcgcctcggttacctgtagtgtatgtaaagcgtgttgtaaagcttctggcaccatgaagcggctcgccgactcccggcggggagccctgcagatgccgagatgaggacatcttatacgttcatgcgtgtgctgttgactagctgaagaagttgcagcagggttgggggtgtgcctcgtgcctgcctggtttcctctgtcgggggaggggggaaagaggcacggaaggtgcctccaggtttgtacaaagtctcgtaatttctatcatatcataaattacc

SEQ ID NO: 4543 - DNA, 846 bp, Triticum aestivum
ccccctcaagaacaccatggactcggtgaaagacgtgctggggaagatgggcaagagattcggcgaggccgcccgcaagacggagaacaccgccggcaacttctggcagcacctgaaaactggaccaagtattgctgatgcagcaatgggcagggtctcccagatcaccaaagtcatagcagaaggtggatatgagaaaatcttccatcaaacgtttgatgtcctccctgaagaaaaactcaagaagccattcgcatgttatctgtcaacctctgctggtcctgttatgggtgtgctctacctgtccaatgtaaagttggccttctgtagtgataacccacttgcatacaaggttggggacaaaaatgagtggagctattacaaggttgccatcccgctagcccagctgaggtccgttaatccttcgacgagcagaacaaacgcagctgagaaatacatccaggtggtctcggtcgataatcacgagttttggttcatgggctttgtgtactatgacagtgctgtaaagcacctgcaggaagcactccaggaggcccgtattttgcaagcttagtgatgtctataggtttggactagcatacagttgtggtatactttgtgtgtcagacaaactgggagttgcccatgtgtagtttgataggtgttgtcgtttgctgcgattcgtgtcactttgaactgggtttttcgatttgtggcatcatatccatcctgtcatgttcgttcatgtgttgtttgatgtctacgaattgaattttcattttgcttccatgaaagagcagtatgttctgaggtagatgcttgtagtacaaagtaggcagattgcag

SEQ ID NO: 4544 - DNA, 958 bp, Triticum aestivum
gggactggatctttctatggaaatcttgactcaggcggagaatgtggtgttcctgcgcaaactgtattctatactcctgctgagaaccgtgcaaaattctggtatgcgacagattatggcatgttcaggttctgcattgctaacacagaagaagattggaggccagggaccgagcagtacaagttcattgagcaatgcctgtcgtcggtcgacaggcagaagcagccctggctcatctttctggcacaccgtgttcttgggtactcatcctgcacttactatgagacagagggcacattcgaggaaccaatgggacgagaagctctgcaggagctctggcagaagtacaaggtcgatctcgccttctacagtcatgtccataactatgaaaggacatgtccagtctatcagagccaatgcaccgttgatgcatcggatcattacagtggcccgttcaaggcaacaacacatgtggttgttggtggtgctggcgctagcatttcagattcagcattcaccacatcaaatatccagtggagtcacttcagggatttcgacttagggttcgccaagctcacggccttcaaccagtcatccttgctgtttgagtacaagaaaagccgtgatggcaatgtgtatgatcatttcacaatttcgcgggattaccgagatgtcctggcttgctccatcgacaactgcccaaggactacgctggcttcctgaagccccaacactttcaaacagggaatcagtttgatctgctaatggttgctggtttgtgtgtggctcaatactagtgtctaagatatttacatagctttgaaacttgtattggctacctgaagccccagtacattcagatgggggaatcagtcgatgtgctactggtaactggtgtgtatgtggcccaatacaagtctgtaagatatttaaatattccaattctgtatacgaaata

SEQ ID NO: 4545 - DNA, 677 bp, Triticum aestivum
ttgatatggtggtaattctgaagttgagagaagatatcatagtacagaagtgccttggtagacgtatttgtagccagtgtggtaagaacttcaatttggcctgcattgatgtcaaggctgaaaatgggctaccaccgatctacatgtcaccattgttaccccccaataactgcatgtcaaagcttcttactcgagacgacgacaccgaagaggttgtgagaaatcgcctgcggatctacaataaaatgagtcaacctgtggaggatttctaccagaagcaggggaaggttctcgagttcgatttacccggaggaatccccgagtcttggccaaagctgcttgacgttctgaatctcgaggaccagcaggagatgaagttggccgcggcgtaagtcctgcccgtgggaaataccttacatagtccaaagcataccttacatttttttcaataatgggaataaagataaaactcttgtttccatagatatgtgtgcctttgtgagagtaatttttgaccagtagtgagctatttattctcgctggcgttttcgcgagccggtgctatgtaacgatcataacgatattttgatcttgacttatttgagtgagcgggttgtggtgcgtaagggcaccatgtaatgttgattcaaagatgaagagtgatagactgtcatctg

SEQ ID NO: 4546 - DNA, 600 bp, Triticum aestivum
  misc_feature (4)..(4): n = any nucleotide
gtcngcggttccctgcactgcgagacggacaagacgccgcagtggaggacggggcccatgggccccaagacgctgtgcaacgcgtgcggggtgcgctacaagtcggggcggctggtgccggagtaccgcccggccgcgagcccgacgttcgtgacgtcgaggcactccaactcccaccgcaaggtgctcgagctccgccgccagagggagatgcaccaccaccaccagccgtcgcagctccagcagcacgcggtcgccggcggcgtcgggaggataatgcacatggagagccacctgctgttcgatgggccggcggcgccgcccatcctcggcggcggcgacgacttcttgatccaccaccgcctagggacggcagactaccggcagcagctcatctagacgagtcgtcagtctgttagaactgatcagtttagcccagaaataataattaaaagcagctaaaaccccaagagccggaaatatcggaagaactgcaaatgtttgcttattaggagttatattttcccagttttctctctgcttccgtttggttagcccgtgtgctttttgttgagctcgaaattttcgtgtccatttaga

SEQ ID NO: 4547 - DNA, 734 bp, Triticum aestivum
cccgcctgctcgttctcccgcaggccccggcctccccgccgtccccggcgtccatggccatctcgccggcggagtctggcgtctcagcccaggcgttccatgtcaagaagccttccaagccggccaagaagaaggaggtgccgccgcaggcaaggcacaggctcaggctcagtcagtgagcgcgcccacagcgccctccggcgtcacggcggcggccaacgaaggtcggcggtgcctgcactgcgagacggacaagacgccgcagtggaggacggggcccatgggccccaagacgctgtgcaacgcgtgcggggtgcggtacaagtcgggccggctggtgccggagtaccgcccggccgcgagcccgacgttcgtgatgtcgaggcattccaattcccaccgcaaggtgctggagctccgccgccagagggagatgcaccaccaccaccagccgtcgcagctccagcagcacgccgtcgccggcggcgtcggaaggataatgcacatggagagccacctgctgttcgacgggccggcggcgccgcccatcctcggcggcggcgacgacttcttgatccaccaccgcctagggacgacggactaccggcagcaactcatctagacgagtcgtcagtctattagaactgatcagtttagctcaggaataataatgaaaagcagctaaaaccccaagagccggaaatatcggaagaactgcaaatgtttgcttatta

SEQ ID NO: 4548 - DNA, 716 bp, Triticum aestivum
ccaagaagatgaagatctccaggatgccctggactccgtagggaacccatgagtgtggaggagatcctaacaatgtgatatcaagcctggctggaagaagggcacaaagatcacctttcctgagaaaggcaatgagacccgtaacgtcataccatcagatctcgtcttcataatagaagaacgggcacacccgaaattcaagagagatgggaacgaccttgtttacacgcatatgatctccctcgtggatgctttgactggctgtgcagtccagctgacaactctggatgggcgaagtttaaccgttcccgtgaggtctgtcatcagtcccacctacgaagaagttgttcagggcgaagggatgccaatcacaagggagccgtctaagaaagggaacctaaggatcaagtttcagatcaagtttcccactgctctaaccgctgaccagaaggcaggggtccagcaacttctgtcttagctgttcgtgcaacgtgagtctacgttcttttccttttgttgagcagttgggaatagacgggtgacatggttacaaaaattgctgaatgtacaatcactatttcgtgctagtgtaaagcgcatgctttcggtactctatttccagcttgactcttggttgctaaaatgctaactgctgacgtgctagcagctgttagcctagtggatctgccttccttttagaagttaacagttcttga

SEQ ID NO: 4549 - DNA, 821 bp, Triticum aestivum
ccgctgcaggattctctccagggtcaggggagcgtccggagggtcgcgaggaagggacgcgatcgacgcagctagcgtgcagtctggaagacctgcacaagggcgccaccaagaagatgaagatctccagggatgtcctcgactccgtcgggaaaccaatgagtgtggaggagatcctaacaattgatatcaagcctggatggaagaagggcacaaagatcaccttccccgagaaaggcaacgagacacgtaacgtcataccatcagatctcgtgttcataatagaagaacgggcacacccgaaattcaagagagatgggaatgaccttgtttacacgcataagatctccctcgtggatgctttgactggctgtgcagtccagctgacaactctggatgggcgaagtttaaccgttcccgtgaagtctgtcatcagtcccacctacgaagaagttgtgcagggtgaagggatgccgatcacaagggagccgtctaagaaaggtaacctaaggatcaagtttcagatcaagttccccaccgctctaacagctgaccagaaggcaggggtccagcaacttctgtcttagctgttcgtacaatgtgagtccacgttcttttccttttgttgagcagttgggaatagacggttgacatggttacaagaattgctgaatgtaaaatcactatttcatgctagtgtaaagcgcatgctttccgtactgtttccagcttgactcttgattgctaaaatgctaactgctgacatgctagcagctgttcgcctagtagtggatctgccttcctcttagattatctgatgt

SEQ ID NO: 4550 - DNA, 1409 bp, Triticum aestivum
ctgccgcatcaccgtcgccgtcgatggagcgacctactaacagtgctcgctctgcccggcgccaccgacgacgagctcaagaaggccttccccgcctcgtcatgaagtaccacccggaccagaacccctctccgcaggccgacaccctcttcaagcaggtctccgtggcctacgacgtgctcagcgacccggataagcgcgccatctacgaccagtacggcgaggaggggatcacagcgggctcccccgccctccccctccccgcgcacgcgcacgcgcacgcccacggcttcgcgcggcacggtcccgggttccgcttccatccgaggagcgccgacgagatcttccaggagatgttcgggggttcgttcttcgggcagggccgcgcggcccttggagcggaggcagcgctccgcagtctgtcccggggtgcgcagccagcgttgccgccgccgctgcaggattctctcccgggtcaggggaggcgtccggggggtcggcgaggaagggagcggcgatcgagcggcagctagcatgcagtctggaagacctgcacaagggcgccaccaagaagatgaagatctccagggatgtcctcgactccgtcgggaaaccgatgagtgtggaggagatcctaactaattgatatcaagcctggatggaagaagggcacaaagatcacctttccagagaaaggcaacgagacacgtaacgtcataccatcagatctcgtcttcataatagaagaacgggcacacccgaaattcaagagagatgggaacgaccttgtttacacgcataagatttcgctcgtggatgcattgactggttgcgcagtccagctgactactctggacgggcgaagtttaaccgttcccgtgaagtctgtcatcagtcccacctacgaagaagttgttcagggcgaaggaatgccgatcacaagggagccgtctaagaaagggaacctaaggatcaagtttcagatcaagttccccaccgctctaacagctgaccagaaggcaggggtccagcaacttctgtcttagctgttggtacaatgtgagtccgccttcttttccttttgtcgagcagttgggaatagacgggtgaaatggttgcagaatttgctgaatgtaagatcactatttcgtgctagtgtaaagcgcatgctttccgtactgattccagcttgactcttgattgctaaaatgctaactgctgacatgctagcagctgttgccctagtggatctgccttccttttagaagttaacagcattaatcagattctgagtttcacatttgctacgggatgcgatagttcttctatcatgtcccagtcttcctggcatatttttttctagaaaattaccatgtttctgattttgccatgttactttgatagaatca

SEQ ID NO: 4551 - DNA, 701 bp, Triticum aestivum
agacatattcttagactgtgaccgtgatcaataatatatctgtacgccagatggacctacatgccatacaggggcagagacctgctactattcttcagtctatgatgcactacaaggttcaaagtccaatcaagagaggcaggtcgccacaactctctactctcttgaagacacgatcagtaggcggaaggaggagatagttactgaagggagtggtaagccatcatggacgaaaaaactactgcttgataaccagctgctttgctcgaaaatacgcgaagaagcgggggaactaattcaaacactggttgagaacgaggacaaatctcgtacagcctcagagatggctgatttgctgtaccacgcaatggtgcttctgagcgtgagggatgtgaagatggaagaggttctggaggtcctgaggaaacgcttttcgcagtccggagttgaggagaaggccagccgcaagaaatcttagcatgatcgcatgtaggtggatgaattccttgtgattgggcagggtgtagtatggagttgtccagctttcttacagtatcacctgagatttagtatcattttgctctctaagaagactgaacttgtgttgtgttttttatttttattttcccttgcacagtcacagcggcaccgttgctgctttggccaataaagtttgtttgctgtgtacccactatatatgt

SEQ ID NO: 4552 - DNA, 660 bp, Triticum aestivum
ctatgatgcactacaaggttcaaagtccatcaagagaggcagtcgccacaactctctactcgcttgaagatacgatcagtaggcggaaggaggagatagttactgaagggagtggtaagccatcatggacgaaaaaactactgcttgataaccagctgctttgctcaaaaatacgtgaagaagcaggtgaactaattgaaacactgcttgagaatgaggacaaatctcgtacagcctcggagatggctgatttactgtaccacgcaatggtgctcctcagcgtgagggatgtgaagatggaggaggtgctggaggtcctgaggagacgattttcgcagtctggcgttgaggagaaggctagccgcaagaaatcttagcatgatggcatgtaggtggatggatgaattccatgtgattgggcagggtgtagtatggagtagtccagttctgctatggtaccacctgagatttatgttttctcatcatgctctctaagaagaagactgtgaacttgtcttgtgttttttattttaccttttcccttgcacagtcgcagtggcgttgttgctgctttggccaataaagcataatatgagtctctgacccatgatatatgtgggtgatttatagtatggaaactatgttttgtcgtgcaaaata

SEQ ID NO: 4553 - DNA, 746 bp, Triticum aestivum
tgctgctcatgtctgacttgctgtagaactttttaaggaggactcggaccaaatgcggcacagaccaggcactgaaaattaggcacaataaacccatgattgagagagtgagcaagcaaagtgagaacctcagctggctatttgagatcctggtgaacaatgatatggcagagaatttcgtcgtgctgtggccgggcaagacgatctcatcaggatgcacgagcaagcgtcaccgatgttcaggtacgagctaagccggatatcagcgggcgtgttcgtcgccctcgggcaagggaaagtgcagtgccccagcgatctgaggagccaactgttccggggatggttcacgccgatgttaactgatttcggctggcttcaaaggtgctcgaaaggactggatgcgagagcgctggaggatagcctggggcaagcccttctcacccttccgcttcgggagcagcagagcctatttgaggaatggttccagtgctttgcatctaggggcgcggaatgcccgaaccttagccgagccttccaggtatggtggcgaaggtcattcactagatagattgtcggtagagccctggagcagcagaagcctatgggatattgcttggtccgcatgagttatatcggtatttgtagtgtgtgtgtgtatgattgtaagataagaagaattcctgttagcctgtagagttgaatttttgtttatgatcttgcctcagttcttcccagtgtatgcacta

SEQ ID NO: 4554 - DNA, 669 bp, Triticum aestivum
acccatgattgagagagtgagcaagcaaagtggaacctcagcgggctattggagatcctggtcaacaatgatatggcagagaatttcgtcgtgctgtgggccgggcaagacgatctcatcaggatgcacgagcaagcgtcaccgatgttcaggtacgagctgagccggatatcagcgggcgtgttcatcgcgctcgggcaagggaaagtgcagtgccccagcgatctgaggagccaactgttccggggatggttcacgccgatgttaaccgatttcggctggcttcaaaggtgctccaaagggctggatgcgagagcgctggaggatagcctggggcaagcccttctcaccctcccgctccgggagcagcagagcctattcgaggagtggttccagtgcttcgcgtctaggggtgcggaatgcccgaaccttagccgagccttccaggtatggtggcgaaggtcatttgctagatagatcgtcggtagagcccctggagcagcagaagcctatgagatattgcttggtccgcgtgagttatatcggtgtttgtagtgtgtttatgattgtaagataagatgaattcttgttagcctgtagagttgaatttttgtttatgatcttgcctctgttcttcccagtgtatgcgctacttgacagtcagagtca

SEQ ID NO: 4555 - DNA, 692 bp, Triticum aestivum
ctttttaaggagactcggagccaaaatgcggcacagaccaggcactgaaagtttaggcacaataataaacccatgattgaaagagtgagcaagcaaatgtgagaacctcagctggctatttgagatcctggtcaacaatgatatggcagagaatttcgtcgtgctgtgggccggacaagacgatctcatcaggatgcacgagcaagcatcgccaatgttcaggtacgagctaagccggatatcagcgggcgtgttcatcgctctcgggcaagggaaagtgcagtgcccgagcgatctgaggagccaactgttccggggatggttcacgccgatgttaaccgatttcggttggctccaaaggtgctccaaggggctggatgcgagagcgctggaggatagcctggggcaagcccttctcaccctcccgctccgggagcagcagagcctgttcgaggaatggttccagtgcttcgcgtctagtggcgcggaatgcccgaaccttagccgagccttccaggtatggtggcgaaggtcattcgctagatagatttgtcggtagagcccctgcagcagcagaagcctatgagatattgcttggtccgcgtgagttatatcggtatttgtagtgtgtgtatgaatgtaagataagatgaattcctgttagcctgtagagttgtatttttgtttatgat

SEQ ID NO: 4556 - DNA, 635 bp, Triticum aestivum
gaaaagaaggctgagctgtatgagaaattatccaggggtgagctacctgatgaagaagaccaggagaaatattgcgttgatttcttccagaaaagttttcatcaagtcagcgagcggcggcagccagagactgctactgcctctgagcatgtagaacaagaaaatgagagtgtcgattctatgctaaatcccaagccagtgggccttggacgaactggtacaacagttgaccaagatgagcacaaacgctttgtcagggaggttcacgacgaagtaagtcaagcaaggcagaaggcttcaacgatgaaacaccggcgacaagagcaggagtcggctcgtagagagaaactcaggcaagctttcctcaagaagcgccttgataagttgatggctgaaaagcaggcatcttcggccagtgatgaccaaccagttagctagtcgaggttttgtatgtcttacttgtctccaggtggcagttgttgtagttcatgtaatcacggttcatgcaactgcaaatgagaagatttgtcttgtttgtggttcccttgatctggcgaaatcaaattcagaaaatggtcttggaatgtacagtcacgcaatgtagaggtaatttgaatcttacactgacgaggtgt

SEQ ID NO: 4557 - DNA, 1132 bp, Triticum aestivum
ctcctcgcccaatccccccttcttcgtcccacgacagaccaatttcttcccaaatcgccaccgccaccgccatgatgtcgtcaccggcagataccgcgccgtcatcctcctccgcggcctcggccgctccgaatcagcatccacagccgccggcgcagcaggctgatacgaaggagcggcggatggagtcgctcgggtggctgacggagtccacggtgatgcccaagaagcacaaggccatcgagggcgtcggcgcggcatccatactcgacctcaaggcccagctctaccgcactcaggaggaagcccgcaattccaccgccgctgacgccgcctccagcgagttccgccgcgccaagaaacgctcgggccccgccgaccccctgggcgccaagaactcaggtgtagacgctcgtgcccacaaggataagctggagctgaaagctgtgaaagatggtactgcatgttattctgccctagaaaagaaggctgagctgtatgagaaattatccaggggtgagctacctgatgaagaagaccacgagacatattgcgttgatttcttccagaaaagttttcatcaagtcagcgtgcgccggcagccagagactgctactgcccctgagcatgtagaacaagaaaatgagagtgtcgattctatgccaaatcccaagccaatgggccttggacgaactggtacaacagttgaccaagatgagcacaacgctttgtcagggaggttcacgacgaagtaagtcaagcaaggcagaaggcttcaacgatgaaacaccggcgacaagagcaggagtcggctcgtagagagaaactcaggcaagctttcctcaagaagcgccttgacaagttgatggctgaaaagcaagcatcttcagcgagtgatgaccaaccaaatagctaatcgagattttgtatgtcttacacttgtgcccaggaagcagttgttgtagctcatgtggtaatggttcatgcaactgaaaatgagaaaacttgccctgcatgtgatctcttgatctagcgaaatcaaattcagaaaattgtcttggcatgtacagtcggttcatcatcatattgttatacaattatgcaacgtagatgtaatttgaatcttctgacg

SEQ ID NO: 4558 - DNA, 1143 bp, Triticum aestivum
atgttctgacctggatgacatatcatgcctggtgtacgtgatcaaaatggtaaccatgtaatccagaaatgcatagagtgcatccctcaggacgttatccagttcattgtctcaactttctatgtcaattgtgctgctatccactcatccatatggttgccgggttatacagaggtgttggagcactgtgatgatcccacaacacagcagataatgatggatgagattctccagtctgtttgcttggctggctcaagatcaatatggtaactatgttgttcagcatgttctggaacatggcaagccacatgagagaactgctatcattgacaagttaattgggcagattgtgcaaatgagccagcaaaagtttgcttcaaatgtcattgagaagtgcttagcttttggtaatcctgtagagcggcagattttgattggtgaaatgcttgagtctactactgaaagtgaacctcttgaggtgatgatgaaagatcagtttgcaactatgtggtgcagaaggtgctggagacttgtgatgatcagcagagagagatgatccttaccaggatcaaagcccacctgaacactctcaagaagtacacctatgggaagcacatagtcgcgcgtgtagagaagctagttgctgctggagagaagcgccaggggcttcaaccagcatgcaccgccgcctgaaggcgggactatgcagttgtacagctaacagtggctaggtttgcgctcgcgtttccccccaacaaccgaaaaccctataagatcgactagtaatggtaccggcatgaataagatacaaatcttggttgcactggagagagtgtacattctgtagctgaggaggcaaagactaatctgagagactaagctgtaaagaggaggaagagggtggagtaagtttgaacatgttactctgctcactgtacaaatttagcactagagaagtgagagaaagctgttagctgtcggaaaaatgtcgagttaaaagccgctgcgactactttgttagtaatcctgctgtgtgtcgtgtcgatagaaacaaaccatgatgatggcttgctgttgttgttgtaagataaaactcttttccgcagtttaagctgaagttattagtatcagctttgctgaccg

SEQ ID NO: 4559 - DNA, 645 bp, Triticum aestivum
tcatggtgtttatgtctaccgaggatccatcgaccctgcctgtatggaaggtacctgtatgctgacctttacgcatcagccatgtggactggcacggagaccccggagggcagtgggaactacacctccagtctcatctccttcagctgctccaagaactctcccatcccctgtgacagcgccgctgggagccctctcccgtcgctcggttacatatattccttcggcgaggataacaacaaggacatctacgtcttggcaagcaaaggcgtctaccgggttgtccggccgagcctctgcagctacacttgcccgacagagaaacctgagacgaacaatgggaaggcacccgcaggtccttcgtcgaacgcgccagcagcattgggaatgggcatgaaaatgggggctttgttgctgtctgctgtcactgccttgtttttgatgagataggaggatcctactacatcgatcatgtattggtatgccgtaagatcaatcctcacattttagcatgtattagcagtacaataataagtcagcatatttctttgtacagttaggagtatgaatcatgacacatggacctatgaggattagattctgaaaacttaatatcagttctgtatgagcatatacctcgttata

SEQ ID NO: 4560 - DNA, 1147 bp, Triticum aestivum
acggatggatacctctatctcatgatgggtgacggtggacagaaaggagatccttttaattttgcgcagaacaaaaagtcgcttctggggaaaattatgaggcttgacatcgacagtacgccgggactcggtaaagtcactaaccaaagcttatggggtaactattccattccaaaagacaacccgttctccgacgatagtggcttggcaccagaaatttgggcattgggcgttagaaacccttggagatgcagctttgatcttgacaggccttcctacttctactgtgcagataccggtcaggtatcatttcaggatcttaaaacagttctaacttgcgaggaccaatacgaagaggttgatttgatctccaaggccggaaactatggatggcgtatatatgagggtccattggtgtacaatccaccgtggacacctggaggaaacacatcactcaagtccgtaaatgtcattcctcctattatgggatacagccattctgacgtcaataaaaacattggatctgcgtcgatcatgggtggttatgtctaccgaggatccaccgacccctgcctgtatggaaggtacctgtatgctgacctttacgcatcagccatgtggactggcacggagaccccggagggcagtgggaactacacctccagtctgatctccttcagctgctccaagaactctcccatcccctgtgacagcgccgctgggagccctctcccgtcgctcggttacatatattccttcggcgaggataacaacaaggacatctacgtcttggcaagcaaaggcgtgtaccgggttgtccggccgagcctctgcagctacacttgcccgacagagaaacctgagacgaacaatgggaaggcacccgcgggtccttcatcaaacgcgccagcagcaatgggaatgggcatgaaaatgggagctctattgctgtctgccgccacgtttttgatgagataggaggatcctactacgtcgattatgtcttggtatgccgtaagatcaatcctcgcattttagcatgtattagcagtacaataataagtcagcaatatttgcttctacagttaggagtatgaatcatgacacatgggcctacgaggattagattctgaaactaaatatcaat

SEQ ID NO: 4561 - DNA, 496 bp, Triticum aestivum
ggcttcgtcgtgttcgtgaatgcatgggcgatcggcagggaccccaagttctgggacgacccggaggagttcaaaccggagcggttcgagaactccaaggtcgacctcaaggggacggatttcgagttcataccgtttggggctgggcgcaggctctgccctggcttggcgttcgggctggccagcattgagatcgtgctggccgtgctgctctaccacttcgactgggagctcccggacggggtggccccgagcgagctggacatgactgaggagatgggcatcaccatccgaaggaagaatgatctgtacctgcgtccaactgttcgtataaaggtgtaggttcttttttcgaaaaggagggtttactccgatctcggcctcttgcataataaacatgtgccgcatagttgccttgcaccgtcaatggtgacgggtttgcccgttgtactacctgtttatcatgacttgaataaaataagcatgaggtttgttc

SEQ ID NO: 4562 - DNA, 1187 bp, Triticum aestivum
cgccgccacgccgccgggagaaaccgtgaacctctgcgagcagatcttttgggtcatcgcggactcgacgatgcgcaccatgatcggcgagaggttcgagaggagggacgagttcctggtggtgttggcggacatcgtcaagatcgcatcgggtttcaccatggccgagtggttcccgtcatcgtggctcgtgcgcgccttcggtggcacgaggcggcgcggccacgcgggctaccttacgacctacgagctggtggagagcgcctaccggcagcgacagaagcgaaaggaggccatggctgcaccgtcgaccaggaaacgccgttgaacgggaagcaggaggacctcgatggcacgagctcatgagcgatacacgaggaaggtgacctcgaggtgccctctcaccattggcaacatcaaggctgtcacgatagatctctttggcgccgggaccgagacgtcagcagatgcactccagtgggcgatgtcagagctgatgaggaacccgagagtgatgcagaaagcacaggccgagctgcgcgacaaactcggcgggaagcctaccgtgaccgaggccggcctggccgacatgacctacctgaagctcgtcgtcaaggagaccctgaggctgcacccggcgctgccattgctcgttccaagggagtgcaacgagacgtgcaagatcatggggtacgacgtgcccaaaggcttcgtcgtgttcgtgaatgcatgggcgatcggcagggaccccaagttctgggacgacccggaggagttcaagccggagcggttcgagaactccactgtcgacctcaaggggacggacttcgagttcataccgttcggtgctggccgcaggctctgccctggcttggcgttcggactggccagcattgagatcgtgctcgccgtgctgctctaccacttcgactgggagctcccggacgggatggccccgagcgagctagacatgactgaggagatgggcatcaccatccgaaggaagaatgatctttacctgcgtccaactgttcgtataaaggtgtaggttctctttcgaaaaggagggtttacccctagcctctgcataataaacatgtgatgcatagttgctttgcatcgtcaacggtgacgagtttgtccaatgtactgcccgtttatcgttacttgaataaataagcatgagc

SEQ ID NO: 4563 - DNA, 496 bp, Triticum aestivum
acctgcccgtgctcgtcgacttcgtcggccgactggtgcgggccctgccgcctcgtcgcccccgtcgtcgactgggcctccgagggatatgaggggagattgaagattgtcgagatcgaccatgacgcgaatcctcagattatcgagaagtacaaggtttacggtctcccggcgttgatcctcttcaaggacgggcaggaggtgccagggagccgaagagaaggcgcgataaacaaggccaagttcaaggactacatcgagcctctcctggagacctcaaatgtggcctgatatcatcgcctgcggtctgcaggaccgattcttgtaatggttcacacttcagaggatgccaaatggcactggcttgagctgcacagcttgcatatcaaagagttttccccactccatcagctctagtctgtaattactaaattacctacacgatcaggactatgtatggctttcattgtatggaaaaaatattagcatatatgaa

SEQ ID NO: 4564 - DNA, 561 bp, Triticum aestivum
  misc_feature (18)..(18): n = any nucleotide
  misc_feature (22)..(22): n = any nucleotide
  misc_feature (27)..(27): n = any nucleotide
  misc_feature (35)..(35): n = any nucleotide
  misc_feature (46)..(46): n = any nucleotide
  misc_feature (50)..(50): n = any nucleotide
  misc_feature (78)..(78): n = any nucleotide
  misc_feature (169)..(169): n = any nucleotide
atgcagtcggcctgcccnttgntcctnacttcgtngccgactggtncggnccctgccgcctcgtcgcccccgtcgtcnactgggcctcctgaggaatacgaggggagattaaagattgtcaagatcgaccatgacgcaaatcctcaaattatcgagaagtacaaggttnatggtctcccggcgttgatcctcttcaagaacgggcaggaggtgccagggagccgaagagaaggcccgataaacaaggccaagttcaaggactacatcgagcctctcctggagacctcaaatgtggcctgatatcatcgcctgcggtctgcaggaccgattcttgtaatggttcacacttcagaggatgccaaatggcactggcttgagctgcacagcttgcatattgaacagtttttccccactccatgagctctagtctgtaattactaattacctacacgatcaggactatgtatggctttcattgcattggaaaaaaagagcatatatcaagggctatcaagaggatgtacacttatttaattgttattaagcaaggtcaatgaataa

SEQ ID NO: 4565 - DNA, 999 bp, Triticum aestivum
atttggttcgacgtatgttggaaccagatccaaagctcaggttaactgcaaagcaggttcttgagcaccattggcttcaaaatgctaagaaagctccaaatgttcctcttggcgatattgtcaagtcaaggcttaagcaattttcgagaatgaatagattcaaaagaagagctctaagagtcatcgctgatcatttgtcagctgaggaagttgaggatataaaggagatgtttaaggcaatggatactgacaatgatggcattgtttcttgtgaagaattgaagagtgggatagcaaaatttggctctcaccttgcggaatcagaagtgcagatgcttattgaagctgtggatacaaacggtaaaggagtactagattatgccgaatttctagctgtctctcttcatctgcaaaggatggcaaatgacgagcaccttcggcgggccttcttattcttcgacaaggatggcaatggttacatcgagccggacgagcttcgagaggctctgaaggatgacggagcagctgatagcatggaagttgtgaatgacatactgcaagaagttgacaccgataaggatggcaaaattagctacgacgaattcgtggcgatgatgaagacgggcacagactggagaaaggcatcacggcactactcgagaggcagattcaacagccttagcatgaagcttgtgaaggacggttccgtcaaattgggcgtggagtaaaagccatggtgtttatttgtgcatgtagttaggcatttgggccccactaagcagcagctcctttagtttttgtcatggtcgttttgcgtggaaatttagataggtggaaccccctctgattggctcacatgtgtaattagttctcctggatcagtggcagtcgcacgcacgcgctgacggatgtaccaagagcagtgcgcctgcttttctgaaccactgatgttaagtgttgtacaatgttttgccgtacacaaatacagtttctagattt

SEQ ID NO: 4566 - DNA, 656 bp, Triticum aestivum
caaccagtgctgcagccagtacggtactgcggcttcggcgccgagtactgcggcgccggctgccagggcggccctgccgcgcgcgacatcaagtgcggcagccaggccggcggcaagctgtgcccgaacaacctctgctgcagccagtggggattctgcggcctcggttccgagttctgcggcggcggctgccagagcggtgcttgcagcaccgacaaaccgtgcggcaaggacgccggcggcagagtttgcactaacaactactgttgtagcaagtggggatcctgtggcatcggcccgggctattgcggtgcaggctgccagagtggcggctgcgatggtgtcttcgccgaggccatcaccgccaactccactcttctccaagaatgatgatcaatcttgctatggcagtattgcaacgacgaataatccgtggcaatctcattgccacctacggtttcccttgacttacttttagagtactagtccttaataattctctagcttgcaatatgatgtgcaggttactgcagcagaaacaaaatattgctgtcgtgcatgcatggaaatattgcagtgagaaagtactgtgtggcaatatagggtgtgctattgttgccgcaaattagttttcttgttatgacctgttgtcagga

SEQ ID NO: 4567 - DNA, 650 bp, Triticum aestivum
acctcgtcaagggtgacgacgaggccgcacttccgccggagttctctgcggcgatcgaaggggcggagcatgctctcgaacgtggtgcccacaggagaaaggtgctagagcatgaggctgtaggggtgtttctcacacactccggttggaactcatcgctcgagggcatctgcggcggcgttccgatgttgtgctggcccttcttcgcggagcagcagaccaactgtcgctataagtgcacggagtggggcatcgggatggagattggggatgatctgagaaggaccgaggtggaagccatgatacgggaggtcatggagggggagaagggccgagagatgcgacaacgcgtgattgagctccagaagagtgcagtggcctccgcacggcctggcggaaggtccatgcgcaatgttgataggctcatccacgaggtgctgctggcttgaaataagcaaattaaagtagtaaataaatgttttggagagcctgaagcacgagcgactcatgttgttcacccgctcacaacaaaataatcaatcccaagccaatgagcatggtcatcacactctagcacagggctttcatgggcccctccctacatcatcttgtaattctgtggacttgtaatgatgatgagcacctccgtc

SEQ ID NO: 4568 - DNA, 824 bp, Triticum aestivum
ggcggccatgtcacaggcctcggcggtggtcatcaacacatgggacgagctcgaatcacccctgctcgacgccatgtccaaactcctgccgcctatctacacagtggggccgctccatctcacggtccgcaacaacgtaccggaggagagccccctcgccggcattgggtccaacctgtggaaggagcaggacgcgccccttcggtggctcgacggtcggccgccgcgctccgtggtctacgtcaatttcgggagcatcacggtgatgtccaaggagcatttgttggagttcgcatgggggctggccaacacaggctacgccttcctgtggaacgtgcggcctgacctcgtcaagggtgacgacgagaccgcgcttccgccggagttcgctatggcgatagaggggcggagcatgctctcgacgtggtgcccacaggagaaggtgctagagcacgaggccgtaggggtgtttctcacgcactccggttggaactcgtcgctcgagggcatctgcggcgctgttccgatggtgtgttggcccttcttcgcagagcaacagactaactgccgctacaagtgtacggagtggggcatcgggatggagattggggatgacgtgagaaggaccgaggtggaagccatgatacgggaggtcatggagggggagaaggggcgggagatgcgacggcgcgggattgagctccagaagagtgcagtggcctccgcacggcctagcggaaggtccatgcggaatgtcgataggctcatccacgaggtgctgctggcttgaaataagcaaattaaagtggtaaataaatggtttg

SEQ ID NO: 4569 - DNA, 959 bp, Triticum aestivum
ttgacataggtaaccaggacagcccctggaagcgccgtatgctctgatataccgaaacatcgcgattcttggtgtggagggcttctctgctctgcccatgcattgcttgcagctttgctgtggattctttgcctttgcactggtggccaacctgatgagggatttccttccacagaagtatggcaaatgggtccccttgcccatggcaatggggttccccttccttgtcggcgcgagcttcgccatcgacatgtgcgccgggagcttgatagtctacatcttgcacaagattgacaggagcaaagcagcacatatggtgccagcagttgcctccggttttatatgtggggatggactttggatcttcccagcttccttgcttgcgttggccaagatcaccccaccaatgtgcatggcatttgcttctacacactagatgggtatcatgcccgatagtggtcgctggctcgcagctctatggtgaataagttgaatgatatataaatccacaaggtgtaaaattgtaagaggtatatcatctttcaagagcagcagatcccattgccaaatgtgggtttccagctgttctctgcaaatgttatcatcggatataaaccatcaaatgaagagttgtcaagtaatgtgtataaactgatgagggtaagactggggtatgaagatagatgagcccactcgacaggattaccgcagcgatgaattactgtatgctgcagcaggaaaacatcatgagtttctgaaaaccatccagcaaattcagtcctgcttagtgcttaccactgaacactgaagacaaaattaggcctatatattactgtgtaattatcttcctgtggtgattattttctttagtgagaagtccctatctatcagtttatgtatgtgcatatctcaaaaaaaaaagtttatgtatgtgcaggagacacgattctcagaataaa

SEQ ID NO: 4570 - DNA, 554 bp, Triticum aestivum
  misc_feature (386)..(402): n = any nucleotide
agatcaagtctggtccaacgacgcagtcaccttccaggagatcacggaggacccgaacatcgacccaccggacctggtggtggacaggataatgatgaggcagcaggtgcgggagttcctgggcatcctgagcacgagggagaaggagatcatcgagcaccgcttcgggatctacgacggcgagcccaagacgctccacgtgatcggcgacatgtacggcctgtccaaggagcggatccggcagctccagaaccgggcgctggacaagctgaagcggagcgtgtccacgcaggggttcgacgtctacttggacctgctgacctcgagtggctaggcagcgcctcattttctctcggttcgattgttcatacacaagggaacacacnnnnnnnnnnnnnnnnngcctaagaagctagaaccccactgacatcctagaactgaagcagagaaacacacagcacactttcagagtttcagtggcatgcttttttgccgggtgtaagtacaaatttcgcagcaagctggtggtacatactacatacatactgatactg

SEQ ID NO: 4571 - DNA, 739 bp, Triticum aestivum
  misc_feature (572)..(590): n = any nucleotide
gcattcgagactgattcggttgccggagagtgtgaatgcacgtctgaaaaaaggtggggaaacaaggctggagtgcatcttggaaggggagcagcctactaacccaaatgtagctaggcggccggcatcacgatcgagaagctggcgaaactcaaagcaaagaccagaaagccacgatcaatgcaggatcaagtttggtccaacgacgcagtcaccttccaggagatcacggaggacccgaacatcgatccaccggacctggtggtggacaggataatgatgaggcagcaggtgcgggagttcctgggcgtcctgaccacgagggagaaggagatcatcgagcaccggttcgggatctacgacggcgagcccaagacgctccacgtgatcggggacatgtacggcctgtccaaggagcggatccggcagctccagaaccgggcgctggacaagctgaagcggagcgtgtccacgcaggggttcgacgtctacttggacctgctgacctcgaatggctaggcagcgcctcattcattctcggttccattgttcatacagaagggaacacacannnnnnnnnnnnnnnnnnnagcctaagaagctagaaccccactgacatgtgcaagcctcctagaactgaagcagagaaacacacagcacactttcagagtttcagtggcatgcttttttgcagggtgtaagtaaatttcgcagcaaagctggtggtacatactcatac

SEQ ID NO: 4572 - DNA, 521 bp, Triticum aestivum
actgatgattctgtggtggcaatagctagcgggtgtccgttgattgaggagtggagccttgctgtctgtcatggcgtccgcttacctggttggtcggcgattggattgaactgcaacaagctaagaattcttcatgtgaaccgttgcagaaacatatgcgaccaaggattgcaggctctcaaggacggatgtgtgcgccttgaggtcttgcatatacatggctgtggaaagattacaaataatggcctggcactgttcagcattactaggcctagtgtgaagcaaatggtggatgaagccatgtccattggcccctccatcgaggatttattccggttgcagtgatcggggaactctgaaagtttagttagaactttgaagttttgacttgagcaaggcgccagcccttgttgtcaccagtgtgtttgtcattacagcaaggtgattggttctttgaccatcaccatgtgtgcattctatttgttccggttcatacttatttggttgatgatgtagaggat

SEQ ID NO: 4573 - DNA, 757 bp, Triticum aestivum
actttcttacctagaagccgagtcctgcatgctttcttcagagggaatgctagacatatcgagtggtggtggactccagtacataaatttgtataatctaaggagttcagctgggctggattgcctaggtggagttggcagtatgaagaaactccgagttctgaatctgaggatgtgccgctatcttactgatgattctgtggtggcaatagctagtgggtgtccgttgatcgaggagtggagccttgctgtctgtcatggcgtccgcttacctggttggtcggcgattggattgaactgcaacaagctaagaattcttcatgtgaaccgttgccgaaacatatttgaccaaggattgcatgctctcaaggatggatgtgtgcgccttgaggtcctgcatatacatggttgtggcaagattacaaataatggcctggcactatttagcattgctaggcccagtgtgaagcaaatggtggacgaagccatgtccattggcccctcaatcgaggatttattccggttgcagtgaccgggaacttggaaattttagttagaatttcaaagttttgacttgaacaaggtgccagcccttgttgccaccgttgtgtttgtcattacagcaagtgattggttctttgccgtcactgtgtgcattctatttgttccggttcatacttatttggttgatgatgtaaaggatgttgccgatagaaccataactatacaaatgaactgtaagaagtcagtttggtgc

SEQ ID NO: 4574 - DNA, 834 bp, Triticum aestivum
acgccaaccacgacacgctggtggcggcgctgcgcaggaacgggttccccaacgtgaccgtcgtcgtcggcgaggtcggctggcccacggacggcgacgccaacgccaacccggcgtacgcgcagcggttcaaccagggcctcctggaccacgtcgcctccggcaagggcacgccgctcacgccgggcgcccccgtcgacgcctacctcttcagcctcgtggacgaggacaggaagagcatccagccaggcaacttcgagcgccactggggcatctttttctacgacgggaagcccaagtaccagctcagcctccgcggcaatggcggcggcatgcttgtgccggcgaggggcgtcgagtacctccagaggcggtggtgcgtgctcaagcccgacgccgacctcgctgaccagaaggtcggcgacagcgtcagctacgcctgcggcagtgccgactgcaccagcctcgggtacaagacctcgtgcggcggcctcgacgccaagggcaacgtgtcgtacgcgttcaacagctactaccagaccgaggaccaggacgaccgagcctgcgacttccgcggactcgccaccaccaccaccgtcgacccctctaccgggacgtgccggttcatcatcgggatcgccccgaccagcacggcgacgaggaacgttgcggccaggacagcggccatcttcttcgcgctgttgctcgcaggcatgttctgaattcaggattgtggtcgatgcttcattagtttagtggtcatctttcaacttttcctttttcttggcagaaatagttgttcatcttgattgaatgattgtcgattgtcttctg

SEQ ID NO: 4575 - DNA, 795 bp, Triticum aestivum
aagcaagcattgagcaatcgaacatggcgaggcttcacctttccgtcgtggcggcctgcgccgtcctcctcgcgctcgccgccccctccctcgccggcgacgccgacatgctccaggacgtctgcgtcgccgacctcgcattcccaatcaagatcaacgggttcccttgcaaggccaacatcacggccgacgacttcttcttcgccggactcaagaaggccggcaactacctaactaacccggctggttcggtcgtcaccgcggctaacgtgctgtcattccccggggtgaacacgctcggcgtgtccatggcgcgcatcgactacgccgtgggagggcagaacccgccgcacacccacccgcgcgccaccgagatcattttcgtcaccgagggaaccctggaggtgggtttcatcaccaccgccaacaagctcttcactaaggtcgtcaccgtcggagaggtgttcgtcttcccgacgagggctcgtgcacttaccacgcagaaacaggggcaactgctctgcactcacgtaaatcgccgccttcaacagccaagcattacaagggcaaccacaagccatcgccaaccaacagcatacatatagagacatagccaacaaccaccagtgccaaccgacgatagactggacaaaggcaattacagggattgataaacgaagaacaatacagaacgcacgtaaaggaccaggttcaaatagggagcctcatgccactacatggcaacatccagcatccatttcggaagaaaaataaatcgtcatgtattgatacatg

SEQ ID NO: 4576 - DNA, 442 bp, Triticum aestivum
ctttgtcaccgagggaactctggaggtgggattcatcaccacggccaacaagctcttcactaaggtcgtcaccgtcggagaggtgtttgtcttcccgcgtgggctcgtgcacttccagcagaacaggggagactgccccgcctccgtcatcgccgcctttaacagccagcttcagggcacccaggccatcgccaccacgctcttggctgccacaccaccggtgccgacggacgtgctggccaaggccttccgggtcgataacgaagacatcgacgccgtcaaagcaaggttcaactagggagcctctgctgtcggcagctctccatccgtttcggaagaaaaaaaatcgtttgtttgttactgaataaatggtaatcaagtcatcaagtgagctgtagcgtgtagttgatttgttgttgtgtatgttacatttgttgctctt

SEQ ID NO: 4577 - DNA, 696 bp, Triticum aestivum
gaggtttgtgatgagcatcgttgggttctacatcattgccaaatgagctggttgcactgttggttgcattttggagtgatacttggaattaatccgtcaatccttgggttaacggtgttagcatggggcaattcgatgggcgacttgatgtcaaatgtggccttggcaatgaatggaggagacggtgtgcagattgctatgtctggctgttatgctgggcctatgttcaatacacttgccggcttaggaatatcgatgctgcttggagcttggtcgacagcacccaactcttatgttcttccgcaggaccgctctcttatttacacgatgagcttcctggttgctggattgatctgggcacttgttacgctgccacggagcggtatgcggcctaacaagacgcttggggttggcctcattgttctctactcagttttccttttcattagagtaagcagtgctatggggatattgccactcccgggcttgaattagttgtttgtgtctattgtacatgactgtcctgtatacagatgaaatggggttgtacattgttcctctgttctgttgttatgcctcaaatttggttgtatgcctgtcaggctttcagagacaataaagccagagcatgcctgcaactggtctacttatttgtaagcttaatcacctttcatgctgatagcataatctaaactt

SEQ ID NO: 4578 - DNA, 699 bp, Triticum aestivum
ttttggaggttttgttatgagcatcgtttggttctacatcatggccaatgagctggttgcactgttggttgcatttggggtgatacttgggattaatccttcaatccttggcttaacggtgctagcatggggcaattcgatgggtgacttgatgtcaaatgtggccttggcaatgaatggaggagacggtgtacagattgctatgtctggctgttatgcagggcctatgttcaacacacttgccggcttaggaatatcaatgctgcttggagcttggtcgacagcacccaactcttacgttcttccacaggaccgctctcttatttacacgatgagcttcctggttgctgggttggtctgggcgcttgtcacgctgccacggagcggcatgcggcctaacaagacgcttggggttggcctcattgctctttactcagttttccttttcattagagtaagcagtgctatggggatattgccactcccgggcttgaattagttgtttgtgtctattgtacatgaatgttgtttatacaaatgaaatgagttcctctgttctgttgttctcatgcctcaaatttagttgtaggctgtcaggtgttggaggcaataaaccagagcttgcctgcaactggtgtacttatctgtaaacttatcaccttgcatgctgatagcaataattttatacttctgatgttg

SEQ ID NO: 4579 - DNA, 806 bp, Triticum aestivum
gccgtcaagccccgcaagccccagttcgacctcaaccaggtcgccgtccagtacctcctcgtcgccccgccgtccccggccgcgtcgccgaacgtcgccgcgggccccgccggcgcctacctctccctcaacatcacgctcctcttcaccgccgtgaaccccaacaaggtgggcatccgctacgccgccacggcgttcgacgtcatgtaccacggggtgccgctcggggtggcggccgtgcccgggttcgagcagcccgcgcacagcacccgcctgctccagacccgcgtcatcgtcgaccgcttcaacgtcctccagtccgacgcccaggacctcatccgcgacgccgcgctcaacgaccgcgtcgagttccgcatcaccggcgacgtcgccgccaagatcctcgtgctcggcttctcctcccccaaagtccaggtgtcggtggactgcgcgatcgacatcagccccaagaggcagtcggtgacatacaagcaatgcggcgtggacgggctaagcgtgtaggcagcaagcgaaccaaaccaacctcgccgccgccgcaacaccgcagaagcggaggctactggtattaatctagtggggatagatatatgtggatgggaatctgtacgtcgattctagtctctaatctcgggttttgattcctttactgcgcgtggggccgggtaaattttgagctctcacctctcctcgccttagtaggttgaggttaccactgattcttgtgaattattgctggatgccattagcagtgagtatataaatcagtcgccatggttcttccatgg

SEQ ID NO: 4580 - DNA, 668 bp, Triticum aestivum
catagcatatggaagcgcggggaagcaactgaagaagagatatcaccgtggccagcgcccaacgctcatgagttcatatcgagcttgcctcagggatacaacaccaacgttggtgagagaggaacacaactatctggtgggcaaaaacaacgggtagctattgcaagggcaatcttgaaggaccctcgggtacttctgctcgatgaggcaacaagtgcctggacgctgaatcagagcgcagtgttccaagatgcattggacaaggtgatggtgagcaggaccaccattgttgtagcacaccgtctctcgacaatcaaaggggcggatacaatcgcagtgatcaaagatggttcagttgccgagaaggggaagcatgaatcgctcatgggcatcaagggtggagtctatgcatcgctggtcgagctacactcaaaggcgtcagcgtcataaaagggtgtgtgcagatttatatcgttcagatctttttcacaactagtagaagataaagactgcattgtgtattttgtattagaagtcgtgtgatgtaaatgtacggaaattttaagccaatcgcctgtaattcttgttttggcttggcctaagacatcagaggtaagattgcctcagcatagcatctgttttagttgttctagctactgcagattgcc

SEQ ID NO: 4581 - DNA, 753 bp, Triticum aestivum
tctatgatccagactctggcacatctcactagatggaacagaactcaaaacttaacactgagttggttaagagaccagatggggctggtaagccaagaaccagtgcttttcaatgacacgattcgtgccaacatagcatatggaaagcgtggagaagcaactgaagaagagattatcaccgtggccaaggcggccaacgcacatgagttcatatcgagcttgcctcagggatatgacaccaacgttggcgagagaggaacacagctatctggtgggcaaaaacaacgggtagctattgcaagggcgatcttgaaggaccctcgagtacttctgctagacgaggcaacaagtgcctggacgctgaatcagagcgtattgttcaagatgcattggacaagataatggtgagcaggaccaccatcgttgtagcacaccgtttgtccacgatcaaaggggcggatacatcgcagtgatcaaagatggttcagttgcttagaaggggaagcatgaatcgctcatgggcatcaagggtggagtctatgcatcgctggtcgagctacactcaaaggcgtcagcgtcataaaagggtgtgtgcagatttatattgttcagatctttttcacaactagtagaagacgaaaactgcatcgtgtattttgtattagaagttctgtgatgtaaaatgtacggaaattttaagccatcgcctgtaattcttgttttggcttggcctaagacatcagaggtaagatt

SEQ ID NO: 4582 - DNA, 563 bp, Triticum aestivum
ggagacgctgcggctgcactccccgatcccgctcctcgtcccccacatgtacctggaggaggccagcctcggcggctacaccattccctagggctccaaggtggtggtcaacgcctggtggctggccaactacccggagctatgggagaagccggaggaattcaggccggagaggttcttgggcgaggagagctacgtggacacctcggtcggcggcggcaaggtggacttccggttcctcccgttcggcgtgggccggcgtagctgccccggcatcatcctggcgctgcccatcctggcgctcatcgtggggaagctggtgaggagcttcgagatggtgcccccgccaggcgtggacaagctcgacgtgagcgagaaaggcgggcagttcagcctgcacatcgccaaccattccgtcgtcgccttccaccccatcgtctcaccatgaccaattacttcaaccgaaagcctacacggctacacggctacacgcacaattactcttcatcagggattacaaagtaatgtctagtactcagatcggatcagctgatgcagcgcaa

SEQ ID NO: 4583 - DNA, 605 bp, Triticum aestivum
aggccgtgatcaaggagacgctgcggctgcactccccgatcccgctcctcgtcccccacatgaacctggaggaggccagcctcggcggctacaccattcccaagggctccaaggtcgtcgtcaacgcctggtggctggccaacaacccggagctatgggagaagccggaggagttctgcccggagaggttcttgggcgaggagagcaacgtggacgccacggtcggcggcaaggtggacttccggttcctcccgttcggcgtggggcggcgcagctgccccggtatcatcctggcgctgcccatcctggcgctcatcgtggggaagctggtgaggagcttcgagatggtgcccccgccaggcgtggacaagctcgacgtgagcgagaaaggcgggcagttcagcctgcacattgccaaccattccgtcgtcgccttccaccccatctcagcatgagcaattacttcttcaacccaaaagcctgatccacatgcacaattactcttcggattacaaatacagtactactagattacaggaaagtatgtcagttgatttaaggggtttacattttttcttttaaaaaaggaggatcacgcgtggcct

SEQ ID NO: 4584 - DNA, 709 bp, Triticum aestivum
cttataaaaagagcttcaaaatgaacaatggaacacgcaatggaagagcaaggtttttgtaaatggtttccctatcccagaccgtgcagtcaggaagctgagaaagttagctggaccatatatcctggtgattactggtatgactaccgtgctggcttctgggtttgtcggtcagccctgccttggcatgatacctccttatattccagagtttaattaccctatgcccaagaattgtggtggtggaaacactggcatttatatcaacggaagagaactccaccagaaggatttggatttacttgtatctcgaggactctctgattcccctgaaagatcttatatagttgaaaattctgggaaagttacagatgaagcatctggcgaagagctatatggccttggcaagcttgcaccaaccgtcgagaaattgaggcgcggatttggtatgcgagtccccaagttatcgtgacaggccagcacgctacgatcatcacccacggataagctcggggataaaccagtggcgtagctgcatccgagaacatggagatttgaagatcaatggcggtcgttctgatttccagaaattgttttcagctccatcctatgtggcctcctggctagttcttgtgcttgttggattgtttatccgaggcctcctatagaggcgtgcttgtaagtttcttcctagctagacgttttgagt

SEQ ID NO: 4585 - DNA, 741 bp, Triticum aestivum
gcaccacttggacatacgacactgaacatgttcatttccctccatgggttcataccacaacaggttcaatggcatggacgcgggccaggatcaattggatgtggaccagctccgccagacgtacgagaccgcgaaacagggcctgcagacaactactacggcacgaagcgggtgacggaggctctcctgcccctgctccgatcctcgtccgacggaaggatcgtcaacgtctcctccaacttcggattgctcagctttttcaggaacgaggagctgaagcaggagctgaacgacgtcgacagcctgaccgaggagaggctggacgagctgctggccatgttcctcaaggacttcgaggccggcggcgcggaggcgcgcgggtggccggccgagttctcggcgtacaaggtggccaaggccgccatgaacgcctactcgagaatcctggccaagaggcacccggagctgcgcgtcaactgcgcgcaccccggctacgtgaagacggatatcaccaggaactccgggatcctgacgccggaggagggcgcgcgcaacatcaccagcgttgcgctgctgccggaaggcgggcccaccggcaagtacttctccgaaggcgaggaggcatccttcgtgtgaaagagcatctgtagtactactgttttgttgcgcttatctgtggtgtgtggtgggataatctgcaaagtcgagttcaaaaaaaggaataaagttacgttagtttgg

SEQ ID NO: 4586 - DNA, 356 bp, Triticum aestivum
tcagaaaagcaggcacaacagctaaacagatcaatatggaaggcgagttcggccatctcatccaacagcagtatgctggacagcacgcacacagctatcatgccgagctctcttgataacctcctcctgaattcgaacacgagtttcttgtacaccggtaagccgccgaagcacggtggagcacccgacagcattgtcgacgggtgggatatggtagagcgtgagatcctgccgccgccgccgtcccagatcgaagacatcgcgcagtgggaaagagcccacacctacgcccgcagtggttctaaaaagaaatgacttgcataatgtaagcttttagaacaccgcaagaagcttca

SEQ ID NO: 4587 - DNA, 994 bp, Triticum aestivum
  misc_feature (56)..(56): n = any nucleotide
  misc_feature (772)..(795): n = any nucleotide
agcggagtagctactggagcacacgacaatcccagagcaaggtttacccacttttngtgccaaggcaaaataattgttctgttcggagaggaaaattcatggacagaaagtggttcgggtaactttggtgttgattctgtggactcggatcagaaatccctttttgactccaagagaagcaatagcttcaacttctcagccgcatcttctcactccattgagaggcatcaagacttgcaaagagggatatctttgctaaagacaagtgtttctgccatcactgcctactactataactcattgggcttggatgtgccacccaatctttctacttttgacgcatttgcaaagatgctccatatgttatcatcttcaaagacccttcgagctgctcttgaatcaaatatcgcctcaagatcagaaaagcaggcacaacagctaaacagatcaatatggaaggcaagctcggccatctcatctaacagcagtatgttggacagcacgcacacagctatcatgccgagctctctagattacctcctcctgaactcgaacacgagtttcttgtacaccggtaagccgccgaagcacggcggagcacccgacagcattgtggacggctgggacatggtagagcgtgagatcctgccgcccccgccgtcccagatagaagacatcgcgcagtgggaaagagcgcacacctacgctcgcagtttctaaaaagaaatgacttgcataacctaagcttttagaacaccgcaagaagcttcannnnnnnnnnnnnnnnnnnnnnnntggatggatgtctgatcatatggttttggtttgtgtatgtatagaagaaagctaaccatggcctatgagttatgcagaagagaagggcattgtagggtagaactgatcagctctgcccccctgtacagcacctgtaatttgtaaatatacctgtatggctgtatacatagcatttactggcaatgaataaatatataca

SEQ ID NO: 4588 - DNA, 791 bp, Triticum aestivum
ccccccagcgcgtcaagatgaattgccagatcgtcgaccccccctcgtccgctcaagctgtgtgccccgtcctcttcagacagagatgacaattcgtctgccatgaatggtttctggtcatgtgcttaccgagtggaaagcgcccccagttgggaaagtgcaaccgcttgaaggacagctctcgcgattttgcccccagaaggttattcctttgtggaatcacagagccacacgggatatgctatcgttgagtttggaaaagactatgcttgcttctgcacgccttcaagtttgaaaatcacttcgaggcggaaggatatggcaacgggactgggaggcacgcaggtatcgagggtcgaagatgtttggatgggttgcaagggctgatgatcaaagaactctggggccaatcggggagcatctgcaaaaaaatggtgatttgaaaactgttgcggaacttgagaatgaaggaacacgcaaaaccgacaaactggtagctaatttagccagccaaattgaggtaaaggccaagcatgtccaagaacttgaatgcaagtacaatgagacgaccaactcacttgacaaggtgatggaagaaaaggagcaggtcctccagagatacaatgatgaaatacacaagatgcagcaacttgctcgtaagcattctcagatgatcatcaatgagaatcagaggctccgttcagaactggagtccaagatgcaggatctcgaaataaaatccaggcagcttgatgaacttgctgtgcgtagtgactcagacagaaggaacc

SEQ ID NO: 4589 - DNA, 626 bp, Triticum aestivum
ggcttcaacacgcttccaagaactgcctgactctctgctacatcttcttcgccgcggctattgccatcaacctgataagagacttgacaccgcacaagttttcgaggttcatcccgctccctatggcaatggccatacctttctacatagggtcatactttgcgatcgacatgttcctgggcagcttcatactctttgtgtgggagaaggtgaacaaggcaaaagcagatgccttcggacctgctgtcgcttcagggttgatttgtggggacgggatctggaccctgcctcagtccattcttgcccttgccaaggtgaatcctcccatttgcatgaagttcttgacaagaggagacaatgtcaaagtggacaaattccttggtggctagtcatggtcttctacggaggacaagggacaacggcaagccacggccacgcatcagcatcagcatgtaattacagccacttcccaggccacttgttttgtagaaaagccagaacttgggtccatgcaagggagaattatccctacgaatcaagtttccgaaacgattgtagctgttccttcacaatgtaaaaaggaagaggaaaaactttagaggcagaacgacatattaggtgtagca

SEQ ID NO: 4590 - DNA, 617 bp, Triticum aestivum
ttctgtgtggtataatgttctgctccagtagtggcgaactacaccggcaatagctgcggggcctccaccatgaccggagccagacctaaacctgccgtcgatcaccatagccgtgctcaaccagtcgagaatagtaacacgaacggtcaccaacgtggcgagcgacgagaactacacggtcagttgcaacgccccctacggggtggcggcgtctgcgacaccggctcagttcttcatccccagcgggcagaagcagctcgtgacctttgtcgtgaacgccaccatgaccaactcttcggtgagcttcggggacgtcgagttctacggggacaaaggtcaccgggtggtcattccgttcacggtcatgtccaaggctgtgtagagttcccgataactgaaaagctgacactgaaacggtgtcctgactgatcaagccatcaaggttgtatacgcagcggtgacctgactgctttggaggtagaatgaccaggatttaccctagttgttttgtttggtgtacattttgaagcatgtcgtccatgtaagtagatgcgtggctaggtgaacaataactgtaaagagaatgtgtatcagaacgcccgtctttcgatgaatga

SEQ ID NO: 4591 - DNA, 705 bp, Triticum aestivum
acatggggaatgggtttccatgccactgctgctttggaccctgggctcatatttgatgcaattacgatgactacctctcctttctgtgtggtataaatggctctgctccagtagtggcgaactacaccggcagcagctgcagggcctccaccatgaccggagcagacctaaacctgccgtcgatcactatagccgtgctcaaccagtcaagaacaataacgcgaacaatcaccaacgtggcgagcgacgagaactacacggtcagctgcaacgccccctacggggtggcggcgtccgcggcaccagcacagttcttcatccccagcgggcagaagcagctcgtgaccttcgtcgtgaacgccaccatgaccaactcttcggcgagcttcggggacgtcgagttctatggggacaggggccaccgggtggtcattccgttcacggtcatgtccaaggctgtgtagagttcctgataactgaaaagctgacgctgtaacggtgtcctgactgatcaagccatcaaggttgtatacgcagcggtgacctgactgctttggaggtagaatgaccaggatttacttactcgtagctgttttgtttggtgtacattttgaagcatgtcgtccatgtaagtagatgagtgggctaggtgaacataactgtaaagggaatgtgtacgaggacgcccgtcttttgccgaatgag

SEQ ID NO: 4592 - DNA, 663 bp, Triticum aestivum
  misc_feature (16)..(16): n = any nucleotide
ggcgccaacgttgganaaggtgcccgggctcaacacctttgggcgtctccatggcgcgcatcgactacgcgccgggcgggctcaacgcgccgcacacccacccgcgcgccaccgagatggtcttcgtcctcgagggcgccctcgacgtcggcttcataaccaccggcaacaagctcgtctccaagaccatcggcgccggcgacgtcttcgtgttcccgcgcggcctggtccatttccagaagaacaacggcgccggccccgcctccgtcatctcggccttcaacagccagttccccggcacgcagtccctcgccatgacgctcttcgcggccacgccgccggtgcctgaccacgtgctcaccacggcgttccaggtcggcaccaaggaggtgcagaagatcaagtccaggctcgccccgaaaaaggcctgactaaacaatgcttacgtactgctcctgagatgtttccttcgagtgatgacatgattcattcaatccctgatttgtatttctactcacttttacttacctgcgttgttttcttgatttgttggatcctcattgtgtaatgctgccctggagcagcaagtacaaaagtggtaggtctgtgctgcttgtaataataagaccagtcatttgttggttctaaatctaatcattccac

SEQ ID NO: 4593 - DNA, 662 bp, Triticum aestivum
acgacgtacgctcggtggtgaccggcgccaacgtggagaaggtgccccgggctcaacaccctcgggcgtctccatggcgcgcatcgactacgcgccgggcgggctcaacgcgccgcacacccacccgcgcgccaccgagatggtcttcgtcctcgagggcgcgctcgacgtcggcttcatcaccaccggcaacaagctcgtctccaagcacatcacggccggcgacgtcttcgtcttcccgcgcggcctggtccatttccagaagaacaacggcgacggccccgcctccgtcatctccgccttcaacagccagttccccggcacgcagtccctcgccatgacgctcttcgcggccacgccgccggtgcccgaccacgtgctcacagcggcgttccaggtcggcaccaaggaggtgcagaagatcaagtccaggcttgcacccaaaaaggcttgactaaacaatactgagcactcctaagatgtttccttggagtgaggacatgattcaatccctgatttgtatttctgctcacttttactcacctgcgttgtttttctggcttcttgatttgttggatcctcattgtgtaatgctgccctgcggcagcaagtacaaaagctcgtgggcgctgcttgtaatgcaataataagatcactcattt

SEQ ID NO: 4594 - DNA, 880 bp, Triticum aestivum
attaaaatgaactgggaaagtgaaatcagaatctcagagatcacacaatctatgtacggtgccgtccatatctgaaagatttcctggagagagtagccagtatgtttgagataatcatcttcacggctagtcaaagtatctatgcagaacaactacttaatgttcttgatcccaaaagaaggttgttccgtcatcgagtgtatcgtgagtcttgtgtctatgtggagggcaactacttgaaggatctatctgttcttgggcgtgacttgtctcgtgttgtcatagttgacaattctccgcaggcctttgggttccaactagacaacggcataccgatcgagagctggttcgacgacccaaacgacaaggagctactagcactgctgccgttcttggaaagtctggttggggtggaagatgtccggccattcatcgcaactaagttcaacctccgccagaaggtggccagcgcgacttccctcgcgatgcacttctttcctaacgcggagcgtgccaactgaagcgttcccacagaaaacaggcgatcaagtgctcgaaaggatatctgaaattcggaatcctttgttgtcgtggtacactcatgtgtcatttaatttcgaaccgccagagagacggatgtataatttgggttattgtatctttctaaaaaccggtaatctttagggaaccttgtacaagcagtagccagacccagaaggggttgtcagtcgtgaccgcgttgcgcgatggatgcgccaagcattgtaataggtcagcagatatttgtcggaatttgttgtgctcactgaagttgtgttgcagcatgtagtttccaagtagagtacacaagtcagtcagtgaggattatagctgccaattg

SEQ ID NO: 4595 - DNA, 1303 bp, Triticum aestivum
acggaggcggtggacgggcggcggagctcaaggaccaggggaacgagcagttcaagtcggggaactacctcaaggccgccgcgctctacacgcaggccatcaagctcgactccgacaaccccaccctctacagcaaccgagctgctgcatttctgcagctggttaagcttaataaggcacttgctgatgctgagacgacaataaaactgaaaccagaatgggagaagggttatttcaggaaaggatgtgttttggaggccatggagcagtatgaggaggcaatatctgcttttcaaatagctttgcagcacaatccacaaaatacagaagtcgcgagaaagatcaagaggcttactcagttagcaagggaacagaagcgagctgttgatgtggagaacctgcgttccaatattgacattgggaagaacttgcagtcattgaaaaaggagctggttacaagtatggagatgcaaaatgggacaaatatattctcatttgttatcagtgtgattgaatcagcgataaaggtttggcatgacacaggaaaggtggatgctaaggtcgattttcttcttgatgatcagaagactgacactgaaaaatatgccccagtggttaacattgagaaggcctttgagtcaccccatacccatggcagttgcttcgcatatttgcggcaatactctgaggagtctttttcaaaggctgcctgtatggtagcacctaagagcatcatctcctatccacaggtctggaaaggtcaaggatcaagaaaatggaagcttgaccagagtgatgggttctttgtacaatttgaatcaccaattttacggaagatatggtttgttgctagcacaacagagaagggacgagcattgtgcaggagccctgagcccttggacattaccatccacgagatccttcctcgtatattcaaagagaacgaagctactgcttgatatctttccaaagcagatgcacagtcgacgacgtcttctttattctactacccctgactgcgtgatccgtattggcggtttatggttgaaaaggggggcaggtattttctcacacaggaagaactgaaatgccatatatcttgtaaaccgacgaccctgtgttggtgtcgtgtacacccaggcactccaattttgttgctgtgtggtttttcgctgtatgcggtgtatacaagctttggtggggttatgctggttgcatttctttgatttgtagaaggaaaagatatgttggagtataacactagatgcttgtgctcagattttattttgtggcttctggctgg

SEQ ID NO: 4596 - DNA, 679 bp, Triticum aestivum
cggctcagccgtgacaccggcgaaccgtggagaagctcccggggctcaacacgatggggcgtctcccatgtcccgcgtggactacgcgtcctggggccgtgaacccggccgcacacccaccccacgcgccaccgagatcatctatgtgcttgagggctccctcgacgtcgggcttcagtcaccaccgccggcaagctcttcgcccgcaccgtctgcaagggtgagcttttcgtcttcccccgcggcctcttacactaccagaagaacaacggtgacgcgccggccgtcgccatatcggccttcaacagccagcttccgggcacgcagtccctcgccctagcgttgttcgcagcctcaccaccggtgcccacggatgtgttggccagggcgctccagatcgacggcagcctggtggaggccatcaagtctaagttcccgccaatgtaactagcatgcatgcatgatgtttgttgggtcggctctacgtgcgtacgtgctgctaataataatgaggaccacgtaaaagtgcagttttaattcatttgcctgacatcctaaaaaagatatttgcctgagaatatcttttgtggcggtgatgtttagtgaatggcctcgtcggttgtactgtataactattgctttttcttcatgaactaatggtgattgatttgtacgtgtc

SEQ ID NO: 4597 - DNA, 442 bp, Triticum aestivum
agaactgcgactgcctccaagcttccaggtgtgccactccctcggcgagggcaccggttccggcatgggcacgctgctgatttcaagatcagggaggagtacccggaccggatgatgctcaccttctccgtgttcccatctccgaaggtctctgacataaaggtcgagccctacaacgccaccctctcggttcagcagctggtggagaactccgacgagtgcatggtgctggacaacgaggtgctctaccacatctgcttccgcgccctcaagctgaccacacctagctgtaagcagatctgtgacatcaagttatattacctacctacctgtactttttttttgactgaatacctgcctgtacttttgttactaatgtgaatggtaaatgatcattatgctggcaacatggtgaattatagcaccggagactggactgtcc

SEQ ID NO: 4598 - DNA, 653 bp, Triticum aestivum
cgtgccgcgcgccgtgctcatggatctcgagcccggcaccatggactccgtccgcacggggccatacggccagatcttccgccccggacaacttcgtcttcggccagtccggcgccggcaacaactgggccaagggccacttacaccgagggcgcggagctcatcgactccgtcctcgacgtcgtccgcaaggaggccgagaactgcgactgcctccaaggcttccaggtgtgccactccctcggcgggggcaccggttccggcatgggcacgctgctgatttccaagatcagggaggagtacccggaccggatgatgctcaccttctccgtgttcccatcccccaaggtgtctgacaccgtggtcgagccctacaacgccaccctctcggttcaccagctggtggagaacgccgacgagtgcatggtgctggacaacgaggcgctctacgacatctgcttccgcaccctcaagctgaccacacctagctttggtgacctgaaccacttgatcagtgccaccatgagcggtgtcacctgctgcctccgcttcccagggcagctgaactcagacctccgcaagcttgccgtcaacctgatccccttcccgcgcctccacttcttcatggtgggctttgcgccgctcacatctcg

SEQ ID NO: 4599 - DNA, 432 bp, Triticum aestivum
tgcaaaattctcgggtacgacatatccaagggcaccacagtactggtaaatgcatgggcgatcggccgggaccctaagcattgggatgatcccgaggagttcaagccggagaggttcgagtctggaatggtcgacttgaaaggcacaaactttgagtacataccattcggggcaggcaggagaatgtgccctggaatgacatttgcgcaggccagcatggagattgtgcttgcctcacttctctaccactttaattgggagctcccaagtggggtcaagccagatgggctagacatgactgaggagatgggcctcaccgtccggcgaaagaacgacttgtatctgcacgtcgtggtccatgtgcccttgatttgatttacacttgcattggtatgtcatatgtgactgaattctcgcatattagtctcttct

SEQ ID NO: 4600 - DNA, 707 bp, Triticum aestivum
tcagttggcccatgtcggagctcatgaggtacccaaacgtgatggcggaaagcacaagctgaagtacgcaaaaacctccaaggtaaaacataaggtgactgaggatgacttggcctatctcaagtaccttagactcgtcatcaaggagacaatgaggttgcatccagccgcgccattgcttctccctagagaggccatggagccttgcaaaattctcgggtacgacatacccaagggcaccacggtgttggtgaatgcatgggcgatcggcagggatcctaagcattgggaggatcctgaggagttcaagccggagagattcaagtccggaatggtcgacttcaaaggcacaaacttcgagtacataccgttcggggcaggcaggagaatgtgcctggaatgacatttgcgcaggccagcatggagattgtgctcgcctcacttctctaccactttgactgggagctcccaaatggggttaagccagatgggctagacatgaccgaggagatgggtctcaccgtccggcgaaagaacgacttgtatctgcacgccgtggtccatgtacccctgatttgatttacacttgcattggtatgtcatatgtgactgaattctcgcatatttgtgccttctatgtgccttggtcaactgtgtgactgctagactgccttgtcaggtgactgccagagatacgttgtcgatta

SEQ ID NO: 4601 - DNA, 568 bp, Triticum aestivum
  misc_feature (95)..(95): n = any nucleotide
ccgacatggctcctcggcctcgccgtcgtgcttgtcctccttcagctcctggccattgcgttggtgtactcgcaagtggccctacgagatcatgnagaaagggtcagccgacgcgggccacgggagattctcatggcggaacctggcgccgcgggtggcgctgcggaccttgtatgttgcggcgtgcgcgtttgtggcggcggcgctgccgttcttcggtgacatcgtgggcgtggtcggcgccttggggttcatcccgctcgacttcgtgctccccgtcgtcatgtacaacattgcgttggccccgcctaagaggtcggcggtgtatgtaatcaacgtggcgatcatggccttgttcaccggtgttgggatcattggcgccattgcgtccgtgcggaagcttgtgctcgacgccggacagttccagctgttcagtgaccatgtcatcagctgaattattttcttgccgcatatgtagaacattttatcatttttaggggaatttcttgttatagctcaggtaaagtagtccggtcaaagcccatcaactactcaaactgtgtcatca

SEQ ID NO: 4602 - DNA, 738 bp, Triticum aestivum
ggtgaaggcgctggtgctgtgctacactgtggtcttcttcaccttctacctgtcggccatctctggctactgggccttcggcaacaaggtgcagtccaatgcgctgcagagcctgatgccggactcgggaccctctctggcaccgacatggctcctcggcctcgccgtcgtgctcgtcctcctccagctcctggccattgcgctggtgtactcgcaagtggcctacgagatcatggagaaagggtcggcagacgcgggccatggaaggttctcatggcggaacctggcgccgcgggtggcgctgcggaccttgtacgttgcggcatgcgcatttgtggcggcggccctgccgttcttcggtgacatcgtgggcgtggtcggtgcgttggggttcatcccgctcgacttcgtgctccccgtcgtcatgtacaacatggcgttggccccgcctaagaggtcggcggtgtacgtaatcaacgtggctatcatggccttgttcaccggtgttgggatcattggcgccattgcgtccgtgcggaagcttgtgctcgacgccggacagttcaagctgttcagtgaccatgtcatcagctgaattagtttcttgtcccctttgtaggtcattttatcatttttaggggaagttctttttatatatctcaaactaaagtaggccgcgcgtggaccatctaccacacaatccaaatcatcgaatatatggttctgtgttacaatatg

SEQ ID NO: 4603 - DNA, 670 bp, Triticum aestivum
  misc_feature (207)..(231): n = any nucleotide
cacccaattcgacgacccaagccggtgagcagacgaacttcactggtgctgttagtaattcaaggctcagggagtcaccggtgccagatttgagctctggttctgccaatgcacaagtcagagaggcgcttgcattgccggagactagactggatattgctgaactgagggtaccgttgatccagccacagccagatagaaccagtnnnnnnnnnnnnnnnnnnnnnnnnnatggcatcgggttgggctcatcaggggcaatcaagcttgggctgggggacttcatattctacagcgtgctcgtcgggagggcggctatgtatgactacatgacagtctacgcgtgctaccttgccatcattgcggggctcggcatcactctgctactgctggcattctaccgcaaggcattgcccgccctaccggtgtccatcaccctcggcgttctgttttacgtgctcacaagaacactgctcgagacatttgttatgcagttctccacaagctttctgatgttttagcatccatgtttgtatgtcattatagttcacattcaaggccttctccagttggttaggttgtattttgggaactgttcatcctggtcacgccatgtttgtgaaactgttaatctgatggcgtacacgacatattgatatatgtaccggct

SEQ ID NO: 4604 - DNA, 1243 bp, Triticum aestivum
aagctccaggagaatatgcattataagatttcacgatagaacaatatgagatggtaaagccatgatacagcaatgcaaatacaagaaaattgataatcgttctccccacagctcaaaccaacaaaaagtacagtttcaacacatgcgcttctttgaaacccaagcaccacactcgatgcgcttcactcctgtggccaattcgcatgtctcatggacgcacgtcatggcaacttctcgttagccttgcgcatgatccagaaaggattcggaacattattgacgtccaacaagaatctgcgctggcccctctcattagtcatctaggtagtagtaggaccctgcattcttttgttctctgtccttcgttgattcgagttgttgattcgtggcctatagttggtcgggtctcttctaaatgtaatgtcaagatgcgataagaatttattcatcccagataccaaagactgtggtgcattggcagtacagtcaatagaagcaagtccctcataaacaataaccttgtccgctaagtaggttgccatgatgaaatcatgctccacaataaatgcagttttcttgcatgaaggatgaatcttttgataaccttcgaggcaacaatacgctgctctgaatcaagatatgcacttggctcatcaattaaataaatatctgcaggctttccaaggcacaaacataatgctactctctggagctctccacctgataaattaataacttcctggtacatgagttgctcaatttgtagtggtttcataacatcagatacaaactgaggatgagtatatgaatcgcgtattttcgaatgaagcaagtgcctcactggatgctggaattttgggctgatcttttgaggcttgtaggacacattgaattcaggaatttcaacctcagttccttccatggtatctggcttcaacaacccggccagcattctgatgaatgtagttttccctgtgccgttctcaccaagcatcacaacaatctgagaatcagtgaattcaccctcaacgacagagagcttgaaatttccctgtgttttgctcatggtagggtacttgtaccgctggtacgtagcaacttcctctgcgttttcctgggtctccgcaatcttaaatgtaagagattcatctcgaaaccgaaggttttctgttggaacaaatccagccaggaaaatattgataacttctcggaccgaaaatggtaacgtaactacaccgtaagc

SEQ ID NO: 4605 - DNA, 766 bp, Triticum aestivum
ttatcaggggagaagctccagagagtagcattatgttttgtgccttggaaagcctgcagatatttatttaattgatgagccaagtgcatatctcgattcagagcagcgtattgttgcctcgaaggttatcaaaagattcatccttcatgcaaagaaaactgcatttattgtggagcatgatttcatcatggcaacctacttagcggacaaggttattgtttatgagggacttgcttctattgactgtactgccaatgcaccacagtctttggtatctgggatgaataaattcttatcgcatcttgacattacatttagaagagacccgaccaactataggccacgaatcaacaaactggaatcaacgaaggacagagaacaaaagaatgcagggtcctactactacctagatgattaatgagaggggccagcgcagattcttgttggacgtcaataatgttccgaacccttctggatcatgcgcaaggctaacgagaagttgccatgacgtgtgtccatgggacatgcgaattggccacaggagtgaagcgcatcgagtgtggtgcctgggtttcaaagaagcgcatgtgttgaaactgtactttttgttggtttgagctgtggggagaacgatcgtcagttttcttgtatttgcattgctgtatcatggctttaccatctcatatttttctatcgtgaaatcttataatgcatattctcttggagcttattatagtcctctcactagtatatcctcatataatat

SEQ ID NO: 4606 - DNA, 1029 bp, Triticum aestivum
ggcagcacgaaaaccaaaagatttcaggtcaaatcaaattctagtactgtataaaaacatcttgtgattgatggacgcacgcatgtgcgtgtgcgtgtgcagggtcggcgtggaccatgctgtcgcggcgcttcgcggagtactgcgtgatggggtgggacaacctggcgcggacgctgctgctctaccacgccaacctcgtctcctcgccggagttctacttccagacggtggcctgcaactcccgcgagttccggaacgccaccgtcaacagcgacctgcatttcatccggtgggacaccccgcccaaacagcacccgctctacctcggccccaaggactaccgccggatggtgctcagcagcgccgccttcgcccgcaagttcagggacgccgacctcgtgctcgacaggatcgaccgggagatcctcaagcgccgaccgccgtcccgcgacgacgatcacggtgatcacgccgcctctgcctctgttgctaggcacggcgggcagttcttcagctacggcgggtggtgctccgagggggaggtggggctgtgctccaacccctgggaacccagcaggaagggggccatcaagcccggcgctgggtcaagaaggctcagggtcatgctcaacaagatgttgtccggaagaaacttcaggaagcagcagctgtacggtgatccacccttctaccacgtccaagtggtctcaactctgatgatccgagccaaggtgtcatgtacatacagtaaagagagccaaacggggtacccagttaaggcaattttggctgagatggtgcaatctcgcagagtaaccacaggacgtgtaacaatcattcatgggttaacacgattacatatttgacacgatcacccttctacctaactctggctggttctttaggttttctattctactagatgatccgtgcgcaaagggcgagcgcaatacaagtattggaagagtgtgcattgtaatatatagatacagatatggaacatatagaacatacacgcataagagc

SEQ ID NO: 4607 - DNA, 787 bp, Triticum aestivum
taacatcaccaccaaccgccggggacttcccaccgccttcaagctcttcaccgggtcggcgtggacgatgctgtcgcggcgcttcgcgaagtactgcgtggtgggatgggacaacctggcgcggacgctgctgctctaccacgccaacctcgtctcctcgccggagttctacttccagacggtggcctgcaactcccgcgagttccggaacgccaccgtcaacagcgacctgcatttcatccggtgggacacgccgcccaagcagcacccgctctacctcggccccaaagactaccgccggatggtgctcagcagcgccgccttcgcccgcaagttcagggacggcgacttcgtgctcgacaggatacgaccgggagatcctcaagcgccgaccgccgccccgcgacgacgacgacgttgatcacgatgatcacgccgcctctggctatcgctgctaggcacggcgggcagttcttcagctacggcgggtggtgctccgagggggaggtggggctgtgctccaacccctgggaacccagcaggaagggggccatcaagcccggcgctgggtcaagaaggctcagggtcattctcaacaagatgttgtccggaagaaacttcaggaagcagcagtgtaggtgatccaccttctacaacgtccacgtggtctaactctgatgatccgatcaaatgtgtcatgtacatacagaaagagagaaaagggataccataggcaattttggctgagatggtgcaatctcgcagagtaacacaggacgtgtaacaa

SEQ ID NO: 4608 - DNA, 792 bp, Triticum aestivum
agcttgaccgcctcgtgtacctcaaggcggcgctctcggagaccctccggctgtacccgtccgtgccggaggactccaagcacgtggtcgccgacgactacctccccgacggcacgttcgtgccggccgggtcgtcggtgacgtactccatctactcggcggggcgcatgaagacggtgtggggggaggactgcctggagttccggccggagcggtggctgtcggccgacggcaccaagttcgagccgcacgactcgtacaggttcgtggcgttcaacgccgggccgcgcatatgcctgggcaaggacctggcgtacctgcagatgaagaacatcgccgggagcatcctcctccggcaccgcctggccgtggcgccggggcaccgcgtggagcagaagatgtcgctcacgctgttcatgaagcacgggctccggatggtggtgcgcccgcgcgacctcgccccgaccctcgacgagctccccgccgcggcacccgccgtcgcggcctgcgcgtagaagatcgatgtgtatggacccccggcgccgtgcatgcatgctccacgtacggttcgtgccatatggggaaggtccggaggacgaagttggaagtggcaagaaaactgtgtagatacacgagtccaacacaccaacaggtactacttagtaggtgagtatatctacatcgggataaagggatctgtctaaaaatatccaaatcagaaagaaagggaaacacacaggggcaacaaacaataatgctcctctcctgtactgtaatgtactgtactaaata

SEQ ID NO: 4609 - DNA, 637 bp, Triticum aestivum
tgtgatagatgattccagccgttgcttgcgtcggatacgaccgcactgacgcgatggaggtgccatcgccgatcaagacggggtcgtggagccctgaggaggacgcgctgctggtggcccttgtccggcagcatggcgcgcgacggtggagcgtgatcagcgccagtgtccccgggcgcacgggcaagtcatgccggctgcggtggtgcaaccagctcagcccggccgtgcagcatcgccccttcacagtgcaggaggatgcgcttatcatcgccgcgcaggcacgctatggcaacaagtgggccgacatcgcgcgactcctccccggccgcaccgacaactccgtcaagaaccactggaactccaacctccgcaggtgccagcgccgcgccaaggccatggccgctgccactgccgcacgtgtcgccgcctcctcctcgtcgtctggatcggctatgagagcgaagatgcagcaggaggaacaagtcatggtgatgaacgggtcgccaccagccgtcgcgcatggtgcagttactgctgttattgatgacccgatgccaatgctgtcactgaccttgagcctgggcctgccccagatggtcgcagataagggctcagaggaggcaagggcaaggaa

SEQ ID NO: 4610 - DNA, 1021 bp, Triticum aestivum
cttaaatgatgcgctctacttatgagaatgatggatttgtattgagcaccccacgcgtcgcaccactcctcggtctgacagaagccgttgcttgcgtctgagacgaccgcactgacgcgatggaggtgccggtgccgatcaagacggggtcgtggagccctgaggaggacgcgctgctggtggccctcgtccggcagcatggcgcgcggcggtggagcgtgatcagtgccggcgtccccgggcgcacgggcaagtcgtgccggctgcggtggtgcaaccagctcagcccggccgtgcagcaccgtcccttcacggcgcaggaggacgcgctcatcatcgccgcgcagtcgcgctacggcaacaagtgggccgacatcgcgcgcctcctccccggccgcaccgacaactccgtcaagaaccactggaactccaacctccgcaggtgccagcgccgcgccaaggccatggccgccgccgccgccgcgcgtgccgccgcctcctcttcctcgtcgtccggatcggccgcgagagccaagacgcaacagcaggaacaggtcgtggtgatgaacgggacgccgccggccgccgtgcatggagcgggtactgctgccgtcgatgacccgcttccaatgccgtcgctgacgctgagcctgggcctgccccagatggccgcggactgggcgtcggaggaggcaaaggcaaaggaaaaggaaaagacaccaccgccggtgggcgtgggggacggtgaagtgcggctgatggcggcgatgcggcagctggtgagggaggaggtggagaggcaggcagggcagctcttgtactcggtcatcatggccaccaccgctgccagggccgacgggacatcgccgtccgatggcccaaccaacggccaccactaaggtgggtagtaaatcatatatggatggttttcagtgtaatctctgtcatttaagtttgtgttgtttcaagacattcccctgttgaatcatgtaatatcttccgtgtttgctattggcaagtt

SEQ ID NO: 4611 - DNA, 558 bp, Triticum aestivum
caaccccaccccccgttccagagcgcgatcacacaacagagcggtagcagttcctgggccgttcccgccccggccggcgccatggacttcgtcttcgtggagaagctcctcgtgggcctcctggcggccgtggtgggcgccatcgtggtgtccaagatccggggccgcaagctgaggctgccgccgggccccttcccggtccccatcttcggcaactggctgcaggtcggcgacgacctgaaccaccgcaacctggcggcgatggcgcgcaagttcggcgaggtcttcctcctccgcatgggccagcgcaacctggtggtggtctcctcgccgccgctggcgcgcgaggtgctccacacgcagggcgtggagttcgggtcccgcacccgcaacgtggtgttcgacatcttcaccggcgagggccaggacatggtgttcaccgtgtacggcgaccactggcgaaagatgcggcgcatcatgacggtgcccttcttcaccaacaaggtggtgcagcagtaccggcccgggtgggaggccgaggcggccttcgtggtggac

SEQ ID NO: 4612 - DNA, 1013 bp, Triticum aestivum
cctcacctcactccctcggtctctctcggccgtcgctgccaccgcctcgacccgtcactctctgccccccgatggcgacggcgacggcgatgtgcgcgacggccgccacgtacggggcaccgatcccggcgccggcacccgccgcattctctcctcaccgcgcggcccggcgggcggcgggcgcgggcggtgacggcgaggccgcggcccctgttctcgccccgggccgtctcggactcgcgcaattcccagacgtgcctcgatccggacgccagcacgagtgttcttgggatcatcctcggtggtggcgccgggacaaggctgtacccactgaccaagaagagggccaagcctgcggtgccgttgggtgccaactacaggctcatagatatcccggtcagcaactgcctcaacagcaatgtgtccaagatctatgttctcacgcagttcaactccgcgtcgctcaaccgccacctctcgagggcctacgggaacacattggtggatacaagaatgatggctttgtcgaagttctcgctgcgcagcagagcccggagaatcctgactggtttcagggtaccgcagatgccgtacgacagtacttatggctgtttgaggaacacaatgttatggagttccttattctggctggagatcacctgtaccgtatggactaccaaaaattcattcaagcacacagagaaacagatgctgatattactgtggctgccctgccaatggacgaggagcgcgcaactgcatttggcctgatgaaaattgacgatgaagggagaattgttgagttttcagaaaaaccaaaaggagagaagttgaaggcaatgatggttgacaccaccatactgggccttgattctgagagggccaaggaattaccttatattgctagcatgggaatctatgtttttagcaaagatgcgatgcttcggcttcttcgtgacaattttccttcagcaaatgactttggaagtgaggttattcctggtgcacagaaa

SEQ ID NO: 4613 - DNA, 785 bp, Triticum aestivum
gcgcgcaggaagagcggccggcggcgcggcgaggcgggcagggtagcatgtgcgacctcgtggcccgcacggggcgccaccagcagcggtacgaagacggcagacggctcgtcgccgggtgcataccattcaggtatagagctgatgaaacttctggtgatgaacagaaaaaagttgttgaagttctcatgataaactcccaaagcggaccaggtttattattccccaagggaggatgggagaacgatgaaacggttgaacaagcagctgctcgagaagctatagaagaagctggagttcgaggagatatagtgcaatttctaggtttctacgatttcaagagcaagacgcatcaggacgcgtgctgccccgagggcatgtgcagagcggcagtgtttgcgctgcacgtgaaggaggagctggcctcatggcccgagcagagcacccgccggaggacctggctgacggtccccgaagccacgtcacaatgtcggtaccagtggatgcaagaggccttgctgacgggcttctctgagtggcatgacaactggagcaaaggcggcagtgcaggtggcgacccaatctaaacgcaagaaggcgtcctcctctgtcgtctctcgctttcctttgccttctcctctgttctcccctctaggccccaaccttgcacgcaaattgcaataatacagtgtggtgcttttacttgatgatgcctagtaggtcattgacccttggttcctgggattgaagtcttagcgtagtggtatatctcatcgacgacgaga

SEQ ID NO: 4614 - DNA, 1019 bp, Triticum aestivum
  misc_feature (31)..(31): n = any nucleotide
  misc_feature (117)..(136): n = any nucleotide
ctctccgcctccccctccacccaccccctcncctcccccgccgcattgctccccgcgcaccgccggaccccactcgccccacaggccggcgagacggcgcgcaggaagagcgggcgnnnnnnnnnnnnnnnnnnnngcagggtagcatgtgcgacctcgtgggcccgcacgggtcgccaccagcagcggtatgaggacggcagacggcctcgtcgccgggtgccataccattcaggtatagagctgatgaaacttctggtgatgaacagaaaaaaagttgttgaagttctcatgataaactcccaaagcggaccaggtttattattccccaagggaggatgggagaacgatgaaacagttgaacaagcagctgctcgagaagctatagaagaagctggagttcgaggagatatagtgcaatttctaggcttctacgatttcaagagcaagacgcatcaggacgcgtgctgccccgagggcatgtgcagagcggcagtgtttgcgctgcacgtgaaggaggagctggcctcatggcccgagcagagcacccgccggaggacctggctgacggtccccgaagccacgtcgcaatgtcggtaccagtggatgcaagaggccttgctgacgggcttctccgagtggcatgacaactggagcaaaggcggcagtgcagctggcgacccaatctaaacgcaagaaggcgtcgtcgtctgtctgtcgtctctcactttcctttgccttctctattctcgtctctaggccccaaccttgcacgcaaattgcaataatacagtgtggtgcttttacttgatgatgcctagtaggtcattgacccttggttcctgggattgaagtcttagcgtagtggtatatctcatcgaagacgagaattatcacaaattttaagtgtctgattctcgcggtgtcatattatttctcaaaattcagcttgattttgatttcttgctcccgattctggggatgcctaccgcaatgtattttaccagacctgaaatcga

SEQ ID NO: 4615 - DNA, 692 bp, Triticum aestivum
  misc_feature (93)..(93): n = any nucleotide
  misc_feature (103)..(103): n = any nucleotide
aggcttcgacagaccagctttgctggtttgaggtcatgcctcttttaccagaggaatccttggatgtagaaattcctgaagaggatctggacnataagttttnacgagagctggaggtaaaggaggccagaacgtgaacaaagtggagacggctgttcgcatggtccatatccccactggcattgccgttcgttgcgcagaggagagaagtcagctggctaacaagataaaggccctaaggcggctgaaggcaaagcttctggtgatcgccgaggagcagcgtgcgtcagagatcaagcagatccgcggtgacgcggtgaaggcggagtgggggcaacagatacgcaactatgtcttccacccctacaagctcgtcaaggacgtccgtacggcgtgcgagacatcagacatcagcggtgtgatggatggcgagctggatcccttcatcaaggcctacctccagtacaagctctctgctgctgccgaggagcaaagcgtcaagtgatgctaacatcgactattcgaggtagccgtatggaattttgatgtgctgttcgtcgtcattggctgtggctgattgagccgccctagtgaaggtgcagttttacagaggcttttgcagtttttgtagtctttgtgcccagtgcctctaaaggttctagatatgaaaaacagtcaaatgataaattgag

SEQ ID NO: 4616 - DNA, 736 bp, Triticum aestivum
atttacgagactggagtaaagaggccagaattgtgaacaaatggagacgcctgttcgcatggtccatatccccactggcattccgttcgttgccagagagaggagtcagctagcaacaagataaaggccctaagacggctgaaggcaaagcttctggtgatcccgaggagcagcgtgcatcggagatcaagcagatccgcggtgacgcggtgaaggcggagtgggggcaacagatacgcaactatgtcttccacccctataagctcgtcaaggacgtccggacggcctgtgagacgtcggacatcagcggtgtgatggatggcgagctggatcccttcatcaaagcctaccttcagtacaagctctctgctgctgccgaggagcaaagcatcaaatgatgctgacatcgacaatccagggtagcagtacggaattttgatgcgctcgttatcgttggctgtggctgattgagccgccctagtgaaggtatgcagttttacagaggcttttgcagtttttgtagtctgtgtccagtgcctctaaaggttctagatatgaaaaacagtcaaatgatgaattgagttgaaggttgtgtctagtgaaacagctcgatgagagtttttaactgttggaaccagaagccacaaaggcatgatggtcgaagcattggtctcgtaacacatggagggtgccttctgtaatctgtactgtactatcggtgcttctttcaccattt

SEQ ID NO: 4617 - DNA, 777 bp, Triticum aestivum
tgatcgcagtcgaacatctcttccttcacaagctgaaagaatacacagggagaggactgtgaagcatccacgaggctgctgcttttgctggtgaaaaaatcgaaaatgatgatggtctcatcctacctccttactcgggccatgtcaccattcatttgtgctcgatgatctctatcctgcaaactacgtgtccaagcccaagtgcctgcacaatggactgcgttctaatggaatgactgaagatggtacagggacaaacggggtgcaaaacagaattcctatcatgtcgagccgtaattcagcaggagggatcagatctttgattggatggttggctaaaacagcggtcatgattgtgggcgccgtatcaatcatgaaggctgctggctacgagcccacaatagggaggagcggcataaaactggacattgcaggtctgttgggtaaagaggcggctggtgcaaaagagcaggttcctcctactctacagtgccctcctgggaaggtaatggtgcttggtggagatggccgggcgcactgcgttgtgaaggaaagagttgagatccccttcggcagcagccttgatgccccaaatgcaagctacggcttaggttgaatccggaaccgggcagtgtgaatattaggttctgttagctggtcctcttggtgttgtgtaggaaccgcgtccacgatttgtttcttgtataatgctctctacttggatatttactatgtatttccctgtttagccctgaatgttgagcggcttatgtatga

SEQ ID NO: 4618 - DNA, 654 bp, Triticum aestivum
  misc_feature (580)..(604): n = any nucleotide
cggcggccaccccagcgccgccgatctgaagcggctggtgtacctgcacgcggccctcctcggagtcgctccggctgtacccaccggtgccgttcgagcacaaggcgggagcgcggccagacacgctgccgagcgggccggccgtgcggcctacgaggagggtgatcgtgtcgttctactcgatgggacgcatggagtcggtgtggggcaaggactgcctggagttccggccggagcggtggctgacggcggcggggcggctccggcacgagccgtcgtacaagttcgtggcgttcaacgtggggccccgtacgtgcctgggcaaggacctggcgttcacgcagatgaagtccgtggtcgccgccgtcctgccgcggttcagggtggaggtcgcccccggtgccgtggtgaggcccaagctgtccatcatactccacatgaaggacgggctcaaggtgagggtttacaagaggcaagacgatgcccgctaggcctacgtacatacctataccgatgctcgcacaaaatgtactactacatattgtggtgtatgttgtatctcctgatttgtgaggttatnnnnnnnnnnnnnnnnnnnnnnnnnaaatactgtataacgaatgatgtgtatacaaaggataaaaaataatgtat

SEQ ID NO: 4619 - DNA, 854 bp, Triticum aestivum
gctggtgtcctgcacgcggcgctgtgcgagtcgctccggctgtacccgccggtgccgatggagcacaagggcgtggtggccgcggaggcgctgccgagcgggcacgaggtgcggccgggggacaagatcatggtgtcgctgtacgcgatggggaggatggaggcggtgtggggcaaggactgccgggagttccggccggagcggtggatcggggaggacggcaagccgcggtacgtgccgtcgtacaagttcgtgtccttcaactccgggccgcggacatgcctcggcaaggacatggcgttcgtgcagctcaaggcggtggcggccgccgtggtgaggaacttcgaggtggaggccgtgcccggacacgtcgtggagcccaagatctccatcatcctccacatgaagaacggcttcaaggccaggatcaagaggaggaagatgctttgattaaatggtgaattcggagcaatagtgtgcctggtgatcgtgaaagaaagatgcatggagtcagcgaatttgtagaccgatcgctgacaagtgacgccgcatgtagctagaaggaaaaatctagtgtcgaactgttgaatgtatcgtgttgcccacttggccagtagcaagtcgtagtcactgttgtcgatctcaaatcgatctagtgtcaactagtggtactcactcggtactgaaatatgcaacgacctgggctaggcccatccattgcgcagcatgtggccagtgggccggcccgtgaggcctgtaatgtacactacatatagcagtgttgcgtgtgcgtgtggggcatgaggattgtaatgactgaatctttgtatccctaatcccagagccttcctctg

SEQ ID NO: 4620 - DNA, 558 bp, Triticum aestivum
cccttcagttctctccaatcccatccgcgtgctgccgtacataaccctagcccctccgcccctgctgatccccgccgcgcggtcatggcaactgctgccgttcgccggtcgacgacgccgtcgggatggacgtcaatgtcctcgcatttccccgcactccgccgtcgccaggaagaataagccgcaccagccccggagcggcgccgcggggaccggcgggggaggcgggcagaagcggctggccgtgctgggcgaggaggggtgcgacttcatcggcgggatcgacgacaagtacctgctggaccgggagctggggcgcggggagttcggggtgacgtacctctgcgtcgaccgggacaccaaggagcagctcgcctgcaagtccatctccaagcgcaagctgcgcacccccgtggacgtggaggacgtgcggcgggaggtggccatcatgcgccacctgccccggagccacagcatcgtggcccttgcgggaggcgtgcgaggacgagggcgccgtgcacctcgtcatggagctctgcgagggcggcgagctcttcg

SEQ ID NO: 4621 - DNA, 512 bp, Triticum aestivum
cccgcccgccgctgtatctagctctcgccgccgccgtccgcccccagatcgccgtagctaggcgccatgggcaactttctgcggcgcgccgtcgacgcagggggcgcacgggggaagaacgacaggaggaagcccaaggcgaacccctacaccgtcgcctacaaccgcggcgcgggggcgccgccggcgcgggcggggctggtggtgctgcgggaccccacgggccgggacctggacgacaagtacgtgctgggcggcgagctggggcgcggcgagttcggcgtcacctacctctgcaccgacgccgccacgggcgcgcggatggcctgcaagtccatctccaagcgcaagctgcgcacccccgtcgacgtcgaggacgtgcgccgcgaggtggagatcatgcgccacatgccgccgcaccccaacatcgtcagcctcagcgccgcctacgaggacgaggacgccgtgcacctcgtcatggagctctgcgagggcggcgagctcttcgaccg

SEQ ID NO: 4622 - DNA, 756 bp, Triticum aestivum
agaggtcatgtcgatggacttatcgagattttccggagcctgatatgttctcggacccttggatctcatgttctcagaaagttctccacctttgccattgggatgagaaccatgcttacacaagggacgctattgagctgtattgtcaggctggtgatggcacaccgttttccagaagtgaattgttaaaatatcttctggaaggaactgtcgactcagggtcgctcccagaaagccttgatggggaagatggagaacatggtactgtcaagggcagcacagctatatcatcaagccagggctcctccggtaagtggatcaaagtaagagaagggaaaactcttcaggaagcgctgcagcataaagactacatcatccccgctgtacctgtgttctttgtggtttcaaggaagtccgccttctattcgaagttcaaggctgggaattggtctttgccgtagagctgcagtttagtagttcagttcaccatattcgttggaagaggctaagggtgctatgggtatatgatcaggaaagagaagctggcaattgtgaaccgctgtatggtcctagaaggttatactacttgagagaaaatgagttgtgctttaattagcacttgtgtgtctcccaaggtccaatcactgtttggttgatggctcaggagtgcgtttctagagggagaaacaactgtattttagctgttctgtatgccctgaatactgatttcgatgcggttatgttgctcaattttgg

SEQ ID NO: 4623 - DNA, 788 bp, Triticum aestivum
tcatgtggatgtgacgtacgatgggaagtggatactgggaaccactgatacctatctgatactcatatgcaccattgtcattgacaaggatgggaaggagaagacagggtttggtggaagaatggggaaccgaattgctgcaccaagactgctcaagctcagcccactgcactctcatcttgcaggggacaatagcaagttccgtgagggcaggttttcatgggtcacggataacggcaagcaggagaggcatctcgtgacgaccgtggggaggtacagcgtggtgtggaacttcctccaggtgaagaacagccaccacgagtgctaccagaaccaggaggggctgaagagctgctactgctacaaggtgatccccaaggacgagtccatcgtggccagtcgcttcatgcatgagaagtacgacttgagcgactgccctgaggcgcctctggtcgtcgcgacgcccatgaaggtcacctccttcagcgtggctagccagcgctagctccgtgcttccgcctctcagtgttcttttttttcagttgggttgttggtctccgtgctgtcatgtaacttcttgacatgcggatctggacttccaagtgtgatgatgactatctatctagtcatggcttgttacaggatttatgagttatgtggattgatagcctaaactatcttacggattgatgatttgtactggctagattgattctagaacttctctgaaagataggatatgaattttaaattctcgcaatacatgatgtattcatctgtccgtgtgt

SEQ ID NO: 4624 - DNA, 664 bp, Triticum aestivum
ggaaggagaagacaggatttggtggaagaatggggaaccgaatgctgcaccaagactgctcaagctcagcccactccactctcatcttgcaggggacaacagcaagtttcgtgagggcaggttttcatgggtcacggataacggcaagcaggagaggcatctcgtgacgaccgtggggaggtacagcgtggtgtggaacttcctccaggtgaagaacagccaccatgagtgctacaagaaccaggaggggctcaagagttgctactgctacaaagtgatccccaaggacgagtccatcgtggccagtcgcttcatgcacgagaagtacgacgtgagcgactgccccgaggcacctctggtcgtcgcgacccccatgaaggtcacctccttcagcgtgtctagccagcgctagctccgcgctgccgcctctcagtgtgtgctttttttccagtttggttgttggtgtccgtgctgtcatgtaacttcttgacccgcggatctggacttccaagtgtggcgatgactatctatcttagtcatggcttgttacaggatttatgattatgtggattgctagcaaaactatcttacacagtgatgacttgtactggctggattgattctgaatttctttgaacgaaggaatgaatttccactctgccaa

SEQ ID NO: 4625 - DNA, 735 bp, Triticum aestivum
  misc_feature (598)..(598): n = any nucleotide
ggcacccacgctcgggcacgggggcgcacgacacgacgagaaaaggacgccacctcctctcctccccctcccctcgtggtctcctcctccgccctcccacacccaaaaagctctagggaaacccccacgcgcgcgcctggtgccggatcggatcggggatgtgggagtcggtggcgctcacgctggccggcgccgccggcaacagcatcggcaaggtcctccagaagaagggcacccacatcctcccgcccctctccttcaagctcaaggtcatacagggctacgcgctcaacaggctctggatcagcggcttcctcctggacatgtgcggcgccgccctcatgctcactgcgctctcgcaggcgccggtctctgtcgtgcagccgattgccggttgcggcctcgccatactctgcgtcttctcccatttttacctcaaggaggtcatgaatggccttgattggcttgcaatcacaatggccggtctcggcaccataggagtcggtgtaggaggggaggagcagaaagtggaagagattccccttttcagtataccttggctggtgctcaccgatctcatcttgtttgtcctgctcancgattggcttcatatctaccaaaagcaaggcgcgaaaagagtgcatgtactgagtgctcagaggtctatcggttaaatcggctttgttggatcacaggacctacaggctgcatgctgacggttccgaagtgtcatgc

SEQ ID NO: 4626 - DNA, 560 bp, Triticum aestivum
caggcaccaacgagagagcacgcaccaccggcggcacccacgctcgggcacgggggcgcacgacacgacgagaaaaggacgccacccggccacctcctcggctcctccccctcgtggtctcctcctccgcccacacccaaaaagctccagggaaaccccccacgcgcgcgcctggtgccggatcggatcggggatgtgggagtcggtggcgctcacgctggccggcgccgccggcaacagcatcggcaaggtgctccagaagaagggcaccctcatcctcgcgcccctctccttcaagctcaaggtcatacggggctacgcgctcaacaggctcttgatcgacggcttcctcctcgacatgtgcggcgccgccctcatgctcaccgcgctctcgcaggcgccggtctctgtcgtgcagcagattgccggctgcggcatcgccatactctgcgtcttctcccaatttttactcaaggaggtcatgaatgggcttgattggaatgccatcacaatggccggatatgggaccataggagctggtttaagaggggaggaccaaa

SEQ ID NO: 4627 - DNA, 1285 bp, Triticum aestivum
agctgatgcgcgcgtcggcggaggtgctcggccgcgggagcgtggggacgacgtacaaggcggtgctcgacggccggctcgtcgtcatcgtcaagaggctggacgcggccaagatcggcccggcggcttcggaggcagagaccttcgagcagaacatggatgtgattggccggctgcggcatccgaacctcgtgccgctgcggtccttcttccaggccaaggaggagcggctgctggtgtacgactaccagcccaacggcagcctccattccctcatccacggttcaagatcgtcccggggaaaaccgctgcactggacttcatgcctgaagatagcagaagatgttgcacagggccttgcttacattcatcaggcatctcggcttgttcatggaaacatcaagtcctccaatgtgcttcttggttcagactttgaggcttgccttaccgacaactgcctgtcattccttctggaatcagcagaagtcaaagacgatgctgcttacagagcaccagaaaacatgaagtcccacagaaggctcacacccaaatcagacgtctatgcttttggcatccttctcctcgagctcctcagcggccaggcgccgcttgagcattcggttctggcagcaaccaatctccagacgtatgcgctgtcggggagggaagacgaaggagtggacagagagcgcctctcgatgatcgtcgacattgcgtctgcttgcgtccggtcatcgccggagagtcggccaactgcctggcaagtcctcaagatgattcaggaggtgaaggaagcagatgcaactggtgacaatgaggacggcgatcttgatcttactagcgactcctagaccctgttcctattcgtcctatggatgaaatggatcatgtccactgggttgatgcattatcccaagtgaacaaccgtagttatatgcagtttgctctgcctagaagagctgatggaagggtgttagtggtgtgggagaatggatttggggtcatgatctctctgactggtgtctcttgagctccgaattctgtagcatatgttaggttttctcccctggtgtacccctggtgtatggatgttgtggtgatgtggacatggtgttgtctttttagcatcaatcttccttggagatttatattatagtgaggttaaaggccaaagtcacatagtactggttcagcaccaatcttctactatgtggacattattaatagtgaagttacagaccaaagtaatgtaccgtgttgagattagtactgatcaactctgctg

SEQ ID NO: 4628 - DNA, 598 bp, Triticum aestivum
cccgcgccttacgcctcgtgaccgcactgccatcttcggctcgaggcgtctcctccctacccagccgtgcctcaccctgtgctgctggtgttcgcgcgcggtcgtcatcaaccttgtgcgagacctggcgccagagaaggtgtcaaggttcatacccgtccccatggccatggcgataccgttctacctcgggttgtacttcgcgatcgacatgtgcgtcggcagcgcgatactgttcgtgtgggagaagatggataaggccggggcggacatgttcgcgcgctcggttgcttcgggtttgatctgtggcgaggggatctggagcatgccgcagtccgtgctggctctgtccaaggtgcagcctccgatctgcatgaagttcctgtccagatccacgaatgctagagtggatgccttcatccaaaccctctcgtccaagacatagcattcattctcgtttaccccattagtactcagcttcgtgatcgtgcaacattatatcgctttgttgatttattaattttgtgctgcttgtttgtctgcgagttttttacggaagcttcatttaaatgccaggatcccatgttctgaattcata

SEQ ID NO: 4629 - DNA, 640 bp, Triticum aestivum
ccggggctgcgtcatcgggccctgcgtcttctggctcttctacagggcgttcgacaacgtcgggctgagcggcagcgactacccggcgccctacgccgtcgtgtaccgcaacatggccatcttcggcgtccagggcttctcctccctgcccaagcactgcctcaccctgtgctgcgtggtgttcgccgcggcggtcgtcatcaaccttgcgcgagacctggcgccagagaaggtgtcgaggttcatgcccgtccccatggccatggcgataccgttctacctcgggtcgtacttcgcgatcgacatgtgcgtcggcagcgcgatactgttcgtgtgggagagggtggataaggccggggcggacatgttcgcgcgctcggttgcttcgggcttgatctgtggcgaggggatctggagcatgccgcagtcggtgctggctctggccaaggtgcagcctccgatctgcatgaagttcctgtccagatccacgaatgctagagtggatgccttcatccaaaccctctcgtccaagacatagcatccatgcattctcgtttacccaactagtagtactactcagcttcgtgatcgtgcaacattatatcgctttaattgatttagtttgtactgctggtttgtc

SEQ ID NO: 4630 - DNA, 659 bp, Triticum aestivum
  misc_feature (569)..(569): n = any nucleotide
attgtcatggatctggctattcggattaatccagcaattgatatgggccaggattgaaggagctttcatccaaggtttgggttgggctgccatggaagagctaaaatggggggatgacaaccacaagtggattcgacctggataccttttcacttgtggtcctggctcgttacaaaataccctctgtaaatgatatacctctcaatttcaaggtttcactattgaagggtgttccaaatccaagggctatacactcatccaaggctgtaggagagccaccgttcttcctcgcttccgccatcttgtttgcgataaaagacgcgatcgcggcagctagggcggaggagggtcatctcgactggttccctctcgacaacccggcaacgcctgaaagaataagaatggcgtgtgttgactcaattacgaagaaatttgcgtgtgtgtattaccgtcccaagcttagtgtatagtggttaactgccagagtagccgatacattcaacgtaaatgtgtacctgttatgtggttgtactatactgtacagtacggacacgctgtgtgcaagatanaagtacagatgaagtgttgatataggattacgaataccacatacttcaaataacctactgaaatatgagcaaaaacaaatattatactct

SEQ ID NO: 4631 - DNA, 766 bp, Triticum aestivum
  misc_feature (709)..(709): n = any nucleotide
ctgatctgcagggatccattaatattcacctaggacggcattgcagaagttgagattgacaccctaactgggatttcccacacaagacagctgatattgtcatggatctcgctattcgattaatccagcaattgatattggtcagattgaaggagctttcatccaagtttggttgggctgccatggaagagctaaaatggggggatgacaaccacaagtggattcgacctggacaccttttcacttgtggtcctggctcttacaaaataccctctgtaaatgatatacctctcagtttcaaggtttcactattgaagggtgttccaaatccaagggctatacactcatccaaggctgtaggagagccaccgttcttcctcgcttccgctgtcttgtttgcgataaaagacgcgaccgcggcagctagggcggaggagggtcatctcgactggttccccctcgacaacccggcaacgcctgaaagaataaggatggcatgtgttgactccattacgaagaaatttgcgagtgtgtattaccgtcccaagcttagcgtatagtggttactgccagagtagccgatacatacaacgtaaatgtgtatacctgtttatgtggtgtactatactgtacagtacagactcgatgtgttcaagataaaagtacagatgaagtgccgatttaggattatgaatactacatatttcanataacctgtactgaaatacgagcaaaaacaaatagtttgatttttttcagttaagtg

SEQ ID NO: 4632 - DNA, 760 bp, Triticum aestivum
cacgacgagatccatccaccccagaggccaagaagagaagggaggagagagagaagccggcggcggcggaggatcagacgatcggagatggtgcggaaggcgaaggttgagttcgacgagaggccgccggatgacttcgacccgaagaacccgtacggggacccggtggcgatgctggagtacagggagcacctggtgcgggagaagtggatccagatcgagaccgccaagatcatccgcgaccgcctccgctggtgctaccggatcgagggcgtcaaccaccaccagaagtgccgccacctcgtcgaccagtacctcgagtccacccgcggcgtcggatggggcaaggaccaccgcccggcggacctgcacgagcccaagaaggtggttgaggtcgaggagtagctctgcttccgctgccgttcctggaatggagaggtcatctttccattcgaagtgaaggaagtaacttgaattgccgcagctcatctcttacctctgaagttgctgataggcatttaataaatgatgatgcgaaggaaacattgttgtgtggtgtctgtattttttcttttgtcaaattcaaggagttaagcaaatcgttgcttggacttgcctaccttgtttcgagtttcatttatacaaatgatgtttagttgcccttttgcctttgcatcttgagtttacaagtgtgtaggctcttgctgtgccgtacaagttctttctattatgtcactgctgccttttttgtatgaaatga

SEQ ID NO: 4633 - DNA, 817 bp, Triticum aestivum
ctccaatccccacgacgagatcatccaccctagaggccaagaagagaagggaggagagagagagtgccgcggcggcggaggagcaggcgatcggagatggtgcggaaggcgaaggtcgagttcgacgagaggccgccggatgacttcgacccgaagaacccgtacggggacccggtggcgatgctggagtacagggagcacctggtgcgggagaagtggatccagattgagaccgccaagatcatccgcgaccgcctccgctggtgctaccggatcgagggcgtcaaccaccaccagaagtgccgccacctcgtcgaccagtacctcgagtccacccgcggcgtcgggtggggcaaggaccaccgcccggcggacctccacgagcccaagaaggtggtcgaggtcgaggagtagcacggtcgcttccgtcgccgttcctggaatggagaggtcatctttccattcgaagtgaaggaagttacttgaactgccacagctcctctcttacctctgaagttgctgataggcatttaataaatgatgatgcgaagcaaacattgttgtgtggtgtctgtatttttttttgttaacttgaaggagttaagcaaatcgttgcttggacttacctaccctgtttccaatttcatttatacaaatgatgtttagttgcctttgcctttgcatcttgagtttacaagtgtgtacgaaagacggctcttgctgtgctgtacaagttctttctactctgtcactgtgctgctttttttggtattaaatgggctgcacattgccgtactgaatgaaatggggaggcagc

SEQ ID NO: 4634 - DNA, 658 bp, Triticum aestivum
aaaggattcaagaaggagctcatggatttgcaaaaggatccaccaacatcatgcagcgctgggcctgctggggcggatctattccactggcaggccacaatcatgggccctggtgacagcccctactcaggaggggtgttcttcgtcaacatccatttccctcctgattacccctttaagcctccaaaagtgaatttccaaacaaaggtgtatcacccgaacatcaactccaacggcagcatctgcctggacatcctcaaggagcagtggagcccggcactgaccatatccaaggtcctactctccatcagctccctgctcaccgaccccaaccccgacgacccccttgtcccggagatcgcgcagctctacaagaaccagagaggccgctacgaggagaccgcgagggcctggacccagaagtacgccatgggctgatcgctgcaaagatgaccgtggcatcgtgtaagacaacttctgtgtcgcgccggtttcccgccctctgagtttcgaccccatatctggctttctctgaaccagttttacttgtgtacagttgtcaaaactgggtgatgtttgcatttctgtttccaaactttgggtgtacgccctgtccctgaagacctgtatgtatcaacacagaacatttttaagaatt

SEQ ID NO: 4635 - DNA, 886 bp, Triticum aestivum
  misc_feature (175)..(175): n = any nucleotide
caagcttgaactaaaagattcagcgtcggccaatggcacacgaggaggccgcgagagagtagcgacgactccaatcgattccagcccccctacgccgacctataatcacattcccacctgctccatcaatcattgccggaatcgattcattcgttccttctctcgggggaccganagcaaaggagagaacaatccaaagccttcccaggcctacagatatggcgacagaaggattcagaagagctcatggatttgcaaaaggatccaccaacatcatgcagcgctgggcctgctggggcggatctattccactggcaggccacaatcatgggccctggtgatagcccctactcaggaggggtgttctttgtcaacatccatttccctcctgattacccctttaagcctccaaaagtgaatttccaaacaaaggtgtatcacccgaacatcaactccaacggcagcatctgcctggacatcctcaaggagcagtggagcccggcgctaaccatatccaaggtcctactctccatcagctccctgctcaccgaccccaaccccgacgacccccttgtcccggagatcgcgcagctctacaagaaccagagagcccgctacgaggagaccgcgagggcctggacccagaagtacgccatgggctgatcgctgcgaagatgaccgtggcatcgcgtaagagaacttctgtgtcgcgccggtttcccgccctctgagtttcgacgatgcccaagagaccccatgtgtggcttcctctgaaccagtttttacttgtgtacagttgtcaaaactgggtaatgtttgcatttctgtttccaaactttgggtgtccgccctgcccctgaagacctgtatgtatcaagacaaaaca

SEQ ID NO: 4636 - DNA, 1039 bp, Triticum aestivum
catgcctgttctcattcgcaggggctcttcgtcctggtgatccaatgtctatcagaggcagctcatcgatcagtgcaggacatcaagtttctgtaaattgttggagtgtgaccttggagagagcaagtgccactccccaagcgcaatcatgaagatgttccagagctctttattctgcttgcagccccagggtgattcctatactagaagatctgccttcgactcaatgttggctggctgcatacctgttttcttccatcctggttcagcatatgtccagtatacatggcatcttccgaagaattatacgagttactccgtcttcatccctgaaggtggcgtccgtgatggaaatgtcagtgttgaggagatactaagaggtatccatccagacatcgtcaagcagatgagggaagaggttatcaatctcataccaaggtgatatatgctgatccaaggtcgaaactggaaacgctgaaggacgcgtttgatgtttcggtttcggcaatcatcaacaaagtgacacaattgagaagagatatcatctcagacagtgaagataaagattttattgaagagaatagctggaaatatgaactgttagaaggacagcggacaattggacctcatgagtgggatccattcttctcgaagcccaagcccaaggacaagggtgcagattctggtaattcatcagctgaagcggccaagaattcttggaaaatcgaacgaggagaccagaattagaccgcacaactgactgctcttagagatgagcaaacagctatcctagctgacggtgcactgatgcaaatccgcggtaaagaatccttagatgctgtagtcttggcgatcatgtatgttcttgatgatccaacccctacagctggtgtaagaagtggtgccaccaaagtccttgagaaaatatgacacatggcctttgctttgcctctacagatatacttttctcatactagaattttcatttgttttgtttgcccataacgctatgtaaatccttgcaagatctagtggtatg

SEQ ID NO: 4637 - DNA, 591 bp, Triticum aestivum
agagggagaagtttttctaccggctccatctccgtctctgccttggatggaggatatcatgttctggacgagtcttacaactacagcagtgacctcagaccacagccaagcaactttggaagccgtcaattggtttgctcgagcttggagtcctcggtgcacaggggattgttcctatgaaaactcgggatggaaaaggttcatcagacacctattgtgttgcaaagtatggatcaaagtgggtccgaacacgtactatcatgaacaatccaaaccccaagttcaatgaacagtacacttgggaggtctatgatccggcaactgtcctgactattggtgctttcgacatggccagcttggagacaggaacggggacaagccatccagtggtaaagatgcgaaaatcggcaaggttcgaattcgcctttcaacacttgaaactggccgagtatacacccactcatatcctctcctggttctgcacccatcaggggtgaaaaagatgggtgaactgcacctagccatacgattttcctcaacgtcattggtgaacatgctgtacctgtactcccgacctttgctgccgaagat

SEQ ID NO: 4638 - DNA, 670 bp, Triticum aestivum
  misc_feature (300)..(327): n = any nucleotide
gtgaaggagagaactcccagtgagaacgtcaccacaatgctcctcctacagctggtgtgagccaaggaagaacactcatgaagatgtgaagcccctgatgggtgacaaacttaaatgcctttgagatcatctccttctccacggggtttgacctgtctggcctattcatccgagaggagtgcagaaaggagacaaggttcacttcagacaagcctgcttcagccatcatctcgaagctggaatatgttgcgaaagcgctgaatctcagggtaaggaagaaggacaatggcgtggtgaagnnnnnnnnnnnnnnnnnnnnnnnnnnnngtgctgttcagttagacatggagatcttcgagatcacaccttcccaccacctcattgagatgaaacaaacaagtggtgatccactggagtaccgggagctattggaggacatccggccagcgctgaaggacatagtctgggcctggcacggagatgaccaccaccagcagctagagtaggttttggaatcttgagtatttagttttggttctgcgaattcgtccagttttcagctggaacgatcctattttacatgcgtgtgttctttgtacaaaatatattttttcctacatgaggtgaggcattctgttcgaggcattgttgagaagttgaaatgcataat

SEQ ID NO: 4639 - DNA, 673 bp, Triticum aestivum
gaaggagagaactcccagtgagaatgtcaccacaaatgctcctcctacagctggtgtgaggccaaggaagaacactcatgaagatgtgcagcccctgacggtgacaaacttaaatgcctttgagatcatctccttctccacggggtttgacctgtccggcctattcatccaagaggactgcagaaaggagacaaggttcacttcagacaagcctgcttcagccatcatctcgaagctggaatacgttgcaaaggcgctgaatctcagggtaaggaagaaggacaatggtgtggtgaagatgcaagcaaggaaggagggaaggaatggtgctgttcagttagacatggagatcttcgagatcacaccttcccaccacctcattgagatgaaacaaacaagtggtgatccgctggagtaccgggagctattggaggacatccggccagcgctgaaggacatagtctgggcctggcacggagatgaccaccagcagcagctagagtaggttttggaatcttgagtatttagttttggttctgcgaattcgtccggttttcagctggaacgatcctattttaaatgcttgtgttctttgtacaaaatatattttttcctacatgaggtgaggcattctgttgaggcattgttgagaagttgagatgcataataaagg

SEQ ID NO: 4640 - DNA, 764 bp, Triticum aestivum
tggtcacggtgcctgatcgacggatcgcgcttctggatccactggtcggcttcttcttcatgcggtgttcatctggggctcgccttcccgtaccaccactggacgacccgtggaaccacatcgggttcgtggtgctgtacgggctcaccttcttcttcgccacttcgggcccaactccaccaccttcatcgttcccgccgagatcttcccggcgaggctccggtcgacgtgccacggcatctcggcggcggccgggaagctgggcgccatcgtggggtcgttcgggttcctgtacctggcgcagaaccaggacccggccaaggtggaccacgggtacaaggccggcatcggggtgaggaactcgctcttcatcctcgccgcctgcaacttcctcggcatgggcttcaccttctgcgcgcccgagtccaacggcctctcgctcgaggagctctcccgcgagaacgaggaggaggcgccggacgccaggacggtgcccgtgtgagaaacacgtcgtcagatagtagtatattctgcgagcaggtttcgatggatgtatggatgttttttatggtcggagagcgttcaactcaggagtcgagtcgagtcgagtacaagaataatctatctaatcttgtgatgggtcgagttgtccaggttaattagggctgctgctcgagttattagcagtgatataggtacggtgtaataccaagtcagagaagtgcatcgaagaggcaagcttatatgtacgtgacgtgtgattg

SEQ ID NO: 4641 - DNA, 1018 bp, Triticum aestivum
tcatcctggtaaccaatagctctttcctcttttggctcaactgctgttgaaagacagagctcgcaaaagctcttgccgaacagctatttgatagtgagaagatgttggttcgctttgacatgtctgaatatgttgggagtagttctgtgttgcgtctcgttggagcacctccaagctatcgtggctatgaagatggtggacaactgaccgagaaagttaggaggaacccgtacagtgtcatcctttttgatgaggtggagaaagcagatccctcggtgttcaatatttttcttcaaatccttgatgatggcaggttgactgatggcagaggccagactgtagatttcaagaataccatcatcatcatgacctcaaatcttggatctgattacctaatatcaaagacggctagagaaaacacaacggaatctacacgggaccttctcatggaacaggtttgcaagcacttcaagcctgagcttctcaacagactgagtgagatcgtcatatttgagccgctttcgcatgacaaactgaaggagataacgaaaatccagatgaagagcattatggccagattagctaccaagggcatctctctttctattagtgatgccgcattggacactatcttatcggaatcatatagcccaacctacggtgcaagacccataaggaggtggatgcaaaagaatgtgatgacaacgctttccaagatgttggtcaaaggacaagccagtgaaggctcaacaatctgcattgaagctactgacgacaagaaggggctggagtatgaagtggtgaagaaggaggcgagcctacactaacctggctctgtttctttgaagaatcggctgcgactgttgctggcctcgctcgccgcgcttcatgctgtgcttgtgttatcgagtgacagtacgctctcgcctgtgacagtacgctatgtattgtgtgtactgcgtatgccagttcacaagacaagattgacgtgaacaaagcaaataacgggatttgcata

SEQ ID NO: 4642 - DNA, 837 bp, Triticum aestivum
  misc_feature (77)..(98): n = any nucleotide
gtgctccggtagtgcccctccctccacacgttccttccttcgcatggctgaccaccacagagacaggggtgtcctannnnnnnnnnnnnnnnnnnnnnaccgcagtggccatggaggctacggcggcgaccaccacgagcagcaccagcagaagcagcccgcgctgatgtgcgccctcaaggccgcgacggcggccacggccgccgggtcgatgctgctgctatccgggctgatcctggcaggcaccgtcatcgcgctcaccgtggccactcccgtgctggtcatcttcagcccggtgctggtgccggcggccatcgcgctggcgctcatgtccgccggcttcgtgacgtccggcgggctgggcgtggcggcgctctccgtgttctcgtggatgtacaagtacctcaccggcaagcacccgccgggcgccgaccagctggaccacgccaaggcgcggctcgcgtccaaggcccgcgacatcaaggacgccgcgcagacccgcatcgaccaggcgcagggggcttgaagatgaggtgcgtgccccgacgcgcggccgatgcgtgggtgatgaacgatatagcgtacgattgctgatccgtgcgcgcgtttgatcgccgccgtgcccgccgagcgagcaagtcgacgacgtttaccacctgttgtgctatccgaccgagtgcgtgtttagacttttgttgtgaactagttgttctcgtcctagtactctagcagtatgtttccgtggtcgaagtcgggagagggtctggatgctggatgtatggtgtgtgcttgtggatgtctctgcgtttatgatgaataaattgccaagttagggcg

SEQ ID NO: 4643 - DNA, 509 bp, Triticum aestivum
ggcgtcctctactgccacatgatcgagccgcggattgtgcgtcaacgagcggatgatcccgcgccgcctgctgccgttcaggagggcgttcagcggcaccttcatggtgaacggggcgtacgaccgggaggaaggggacaaggccgtcgccgatggctacgccgatcttgtggcgtacgggcggctcttcctggccaaccccgacttgccggagaggttcaaaaggaacgccgctctgaataagtatgacaggagcacgttctacacatccgaccctgttgttggctacaccgattacccttttcttgatcaggaggattagctaactggttggttcacggtcgtcgtgcttgggacttgggagcttctatcatcatcgttgattaagaagtaactccaaggctcacgctcgaccttgcatagcacacaaaatcaggctgggggaatgtttttatgtggtgttagctccagattgtattatggcaggcatctgcagatcccttagaatt

SEQ ID NO: 4644 - DNA, 509 bp, Triticum aestivum
gggctcggtgtcctctactgccacatgatcgagccgcggatgtgcgtcaacgagtggatgatcccgcggcgcctgctgccgttcaggaaggcgttcaagggcaccttcatggtgaacggcgggtacgaccgggaggaaggggacaaggccgtcgccgaaggctacgctgatcttgtggcgtacgggcggctcttcctggccaaccccgacctgccagagaggttcaggaggaacgcggttctgaataagtatgacaggagcacgttctacacatctgatcctgttgttgggtacaccgattacccttttcttgaaacggaggattagctaagggcatgaacagtgattgataagacattcttatcttaatcctttcatgcaatttagagatgacaataaaaccatgtctacgatagagtatgtcttagtcttatcttaaataactagttatttgtaatatatagtgagacatattgtgctaggagatcatctcttaaataagagaaaac

SEQ ID NO: 4645 - DNA, 670 bp, Triticum aestivum
cttggccaaggggaactcgttgaaggaggattgaagcctctacaggttgtcgtgtttttatcagagggaagggctcaattaaagatcctgggaaggaggaacagctgaagggaagacctggttacgaacacttggatgatcccctgcatatcttgattgaagcagagttacctgccaatgtcattgatgcaagactctcaaaagcacaagagatcctagaagagttgttgaaaccagtggatgaatcacaagactactacaagaggcagcaactccgcgagcttgccatgctgaactcaccgctccgagaggagagccctcgtctaagcccgcatccaagtccgcacccaagcccgcatcaaggcggcgcttcacccttcagtaacggtgggatgaaacgaagcaaacaatgactgcagaggcctgctcctcccaactttgacccttccagaaacccgccctcaatcgatgccctcacagcctaatttttcatgagcaagctttcatgatggtgttggcattcgtgcgaaacctgtgttactagtagaattttgatgagtctccgttgtgacattagcctatgatgactgactgagaatgatccatgatagcgaatcctccgcctttataattagaacatttgatttatttgttgctggtaatgctgaga

SEQ ID NO: 4646 - DNA, 500 bp, Triticum aestivum
gcgctgcgcgcgcgcccggccttctcctggcggaagctctggcgcttcacggggcccggcttcatgtgcgcgctcgtgcagctcctctggctgctgctctgggccacggtcatgggcgcgctcgtgcagctgctcttcgcgcgcctcggggtcgtcaccgggaagcaccccgccgagctctgtcgggaggagtacccgccctgggccacacgcgcgctctgggtcgtgacggagctcgcgctcgtcggcgccgacatacaggaggtcatcggcagcgcgattgccatcaagatcctctccgggggcatcgtgccgctctggggcggcgtcgtcatcaccgccttcgatctcgtccaggccgacgccgtggctgccttccgctcgctttgacggcacgacatccttcccgctctgttgctgcgacgccattgccactggctcagcgaggcaggcgactcctggctcttccagcagaagctcgccaccgccgagctcgcctc

SEQ ID NO: 4647 - DNA, 699 bp, Triticum aestivum
cggggcccgcttcctgatgacatcgcgttcttgacccggcaacctcgaggggacctccagccggcccgcgccggggacacgctgctgtgctgctcatgtgggccaaccccaatgggcctcctcgtgcagctcctcccgcgcgcctcgggtcgccaccgccggcacctcgcagagctctgccgtgacgagtaccccgactgggcgcccgcgcgctctggctcatgccgaggtcgccatgtcggcgctgacatccaggaggtcattggcagcgcgatcgccatcaagatccttagcaatgggtatctgccgctctgggccggcgttgtcattaccgccttggactgtttcattttcctttctcttgagaactatggtgtgaggaaactggaagctgtatttgcagttttgattgcaacgatggcagtgtccttcgcatggatgttcactgataccaagcccaatgggaaggatctgttaattggtattttggttccaaaattgagctctaagacaataagacaagcagttggggttgttggctgtgttattatgccccacaacgtgttcctccattcagcgcttgtgcagtcgaggaaaatagacccaaaaaaggagtaccaagtccgtgaagcattgagatactactcaatagagtcaacggtcgcattggctatatccttcatgataaatctctttgtc

SEQ ID NO: 4648 - DNA, 668 bp, Triticum aestivum
cgcgtcgacggcttctcctcgctccccaagcactgcctcacgctctgctacgtcttcttcgccggcgccatcatcatcaacctcgtcagggacttggtgccggccaaggtcgccaggttcatcccgctgcccatggccatggccataccgttctacatcggctcctacttcgccatcgacatgttcgtcggcaccgtcatcgtcttcgtgtgggggatcgtgaataaggccaaggccgacgcgtttgcgcccgcggtcgcctcggggctgatctgcggcgacggcatttggacgctgccgcagtccatcctcgcccttgcaaaggtgaagccgccgatttgcatgaagtttctatcgagatccgtcaatgccaacgtggatgcctacctaggaaattaattagctgtgaggcagttctcctttcttccttgaaaaaaaaaggaaagcatccctgtctatagtttgaagttacacgttctgtactctatcatcatcatcctataatcacgactgtatatggattaattgttacgtatggtgattttgtagctaatgcacataagctttaaggttgtgcttgttaataagtggctatagggatgtaaatggcaaataagcggcgtctacagtcccgtttggttagctttagctagcttcttagtgcattc

SEQ ID NO: 4649 - DNA, 608 bp, Triticum aestivum
tacaaggccttcgacgacatcggcatcagcggcagcgagtaccccgcgccctacgccatcgtctaccgcaacatggccatactcggcgtcgacggcttctcctcgctccccaagcactgcctcacgctctgctacgtcttcttcgccggcgccatcctcatcaacctcgtcagggacttggtgcccgccaaggtcgccaagttcatcccgctgcccatggccatggccatacccttctacatcggctcctacttcgccatcgacatgttcgtcggcaccgtcatcgtcttcgtgtgggggatcgtgaacaaggccaaggccgacgcgtttgcgccggcggtcgcctcggggttgatctgcggtgacggcatttggacgctgccgcagtcgatcctcgctcttgcaaaggtgaagccaccgatttgcatgaagtttctatcgagatccgtcaatgccaacgtggatgcctacctaggaaattaagtcagtgcctgtgcggcagttctcctttccttggaaaaaaaggaaggcctccctgtctatagtttgaagttacacattctgtactgtatcatcatcctataatcacgattgtatatggcctgtta

SEQ ID NO: 4650 - DNA, 823 bp, Triticum aestivum
tcctaacgcagttattactcttcatagtttgatcaaattggaagggtgggaaagcatggttactattatttctagtgacatgcggtgctgggatgctcctgaaaaagctgatattttggtcagcgagttgcttgggtcctttggtgataatgagttatctcctgagtgtctagatggtgcccaaagattcttgaagcctgatgggatttctattccttcatcttacacaagctttgtccaaccagtaactgcatcaaaactacacaatgatattaaagcacacaaagatattgcacattttgaaacggcatatgttgtcaagctacaccgagtagcaagacttgcacctccacaagaggttttctctttcacacatccaaacttctcaccaaaggtcagcaaccaaaggtatacaaagttgcagtttgaactaccacaagacacgggatcatgccttgtgcacggattcgctggatattttgatgccgtactatataaagatgtccatctaggaattgagccgaacacatgtacaccaaacatgtttagctggttcccaatctttttcccactgaggaagcccatatacgtgccgtcagagtcgcccatagaagtgcacttttggcgatgctgtggtgccaccaaggtgtggtacgagtgggctctggtggcgccgtctccttccccaatccacaacagcaatggccgttcgtactgggttggtctataattcgaaaaatcagaatactcgcatgtcgtttcttttgagagaagtgacgatcatatgcttggtttttgagtgcgtccggctacctggatcaaa

SEQ ID NO: 4651 - DNA, 732 bp, Triticum aestivum
cgtcctccggttatatccacgtcggggtttcacacgcctgggacatgcctgagaacaccgttcggttgcttgcctatgctcagttcatgggtatcaaggatcttctcagccagaacgaccgccccaccagttcgcttcatggaaccgacgacctcgccttcgtcgcgacccgtgcccgtgaggtgcacgacttctggcacgtgctgttcggcctcccgaccacctgatcggcgagactgctctcaaggtgatcgagttcgagcagatgttcctcccgatgtgcatgctctctgtcgtcgggggctccgcgaggttcagcgagaagcagaggaggctgttcttccagcactatttcccatgggcgaccaaggcaggtgtcaaggctactgatctgatgtccgtgtactatgagaagcacttccatgaagatctggaggaggtgaggaggaactgggggatcgtaccgtgcccggatcccaagacgacgagcagtgcttagactttaagcaagtgcatttttgcataaaaacgtctgtatcttggtttttcagccttgcttgttgtcagtttctctttgtgagaatgataccatgaattgtgctgctgatatgttagcaagtaaatagggtatggtagctgttggatgttgcttcgtaaggtaatatgcaatgttatccacaaactacttatatgatgatatatcttctcggtttgctcgaacacttatactat

SEQ ID NO: 4652 - DNA, 760 bp, Triticum aestivum
cggaagccagcgttcgagcgtgtgctccagcgcaggaagaacagcgccgaaggcagggaaatcttttcgagcgtcctcgggttaatccactcgggttttcacgcctgggcatgcctgagaacacgttcggtgctgcctatgctcagttcatgggatcaaggaacttctcgccagacgaccgtccaccagttcgcttcatggaaaccgacgaccttgcctttgtcgcgacccgtgcccgtgaggtgcatgacttctggcacgtgctgttcggcctcccgaccaacctgatcggtgagactgctctcaaggtgatcgagttcgagcagatgttcctcccgatgtgcatgctctctgtcgtcgggggctccgcgaggttcagcgagaagcagaggaggctgttcttccagcactatctcccatgggcgaccaaggcaggtgtcaaggctactgatctgatgtccgtgtactatgagaagcacttccatgaagatctggaggaggtgaggaggaactgggggatcgtgccatgcccggatcccaggcgacgagcagtgcttagactttaggccagtgcatttttgcataaaaacgtctgtatctttggtttctcagccttgcttgttgtcagtttctctttgttaacaagtaaatagggtatggtagctgttggatgttgcttcgtaaggtaatatgcaatgttgaccacaaactacttgtatggtatatcttctcggtttgctcgaacgacttataatattct

SEQ ID NO: 4653 - DNA, 600 bp, Triticum aestivum
atgactggattgataaccaatggaagccacgttgcacagaatctgtcaggaacaaaattcacaggaggcgacagggttgaagtgagcagcgacgaggaaggtttccacggagcatggttccaggggacggtcgtcaaatccgtgggacacaagttccttgtggagtacgatgcgctgaaggacgatgacgagaccacgcctctgaaagaaaccataggggaggagcacatcaggccctctcctccggctattcctgtcaccaatggtttcaaggtccttgacgagatcgacgcctacaccaacgatgggtggtgggtcggcgtgatatccgaggtcctcagcaaccagaagtacaaggtttacttcaaggcgtacaaggagcaggatgagtttgagctcgaacagctgaggcgtcactgcgattgggtggggggtaggtggatccaggcttccctggtaacctctactgcctatccgttgccccgcatctaagtttacagttgataatgaaattagcactagtgatgacgatttactgatagctggatagctactacccatgtttgtcccgtcttgacgttcagttaatattattatcat

SEQ ID NO: 4654 - DNA, 996 bp, Triticum aestivum
ctgtgcaatgagattatcaacatcaagcacatcagaccttgcccgccacgtgcatcagttattagtttctgcgtcaatgatgatgttgagggcttccaagatgatggctggtggccagggaagatcactgagatccatcccaagttaacatatacatttaagttagcaacttcaggaaagaaggttcagttacaccagaacacactgaggcttcgatatgactggactgatgaccaatggaagcaagttgcacagaatctgtcgggaacaaaattcacaggaggcgacagggttgaggtgagcagcgacgaggaaggtttcaacggagcgtggttccaggggaccgtcgtcaaatccgtgggacacaagttcctcgtggagtacgatgcgctgaaggatgatgacgagatcacgcctctgaaagaaaccataggggaggagcacatcaggccctcccctcctgctatccctgtcaccaacggtttcaaggtccttgacgagattgacgcctataccaatgatgggtggtgggtcggcgtgatatctgaggtcctcgacgaccagaagtacaaggtttacttcaaggcttacaaggagcagaatgactttgagctcgagcagctgaggcgtcactgcgattgggtggggggaaggtggatgcaggcttccccggcgctggagatgtgacagctgaagggacacacgcatctttgtacaggagcctgggataattagtagtcctacccatgagagtgtggcttcactagttatgatggttgctgaactgaagctgtgttatgcgcatagaaaggccagcaaatcggtagtagatggcctttctgcattgccattcccgcagcaggtgatctagatgagatgttcgtcgacgggagactttcacctttcaccgtcacaagtaagatttcgtcgtgctttttatgtaaaccacctaaggacgaacctctgggtacatcgtcgctattcacgactccgcct

SEQ ID NO: 4655 - DNA, 702 bp, Triticum aestivum
tccggcgcgtgatgcacccgatcgacgtggccgggcgcaacgcgtgcgggcagcacgacgaggcccgcgccatcgcgcgcaccatgccggcgctccgccacctggaggtgggctacatgctggtcactacggaggccatcctggaggtgctctcccggtgccggggcctggagttcgtcgacctccggggctgctgggccgtcgacgaggcgctgctgcgggagcgccacccggggctcagcgtcctcggcccgggcgtcgacgactgcttcgagaacagctactgggaggagtgctccgacgtacgacgatcgactctgacgacgaggtctactcgtgggagctcatggacgtcgtacgagtactacggcgtggtcggcagctgacgtacgacgagccggtgtggggcgacgggccgggcctcgtggagaacctcgaggtgaggttctacggcggcgggttcagcgagagctacgccggcttcgactggccagcgtcgccgtgacagtcccggccgttcgtgtcaccttgaccgcaaaagaagtcaagtatccttttcgttctcgacgttcgtatggtcgttcagatatgtgtgcgtgtgcgtgtgcgtgccagtagcttaatctgggtgtgtgatgtgaacttaatctgatgttaagtttaaaaaaacttaatctgatgtttactacatgaagcaaatca

SEQ ID NO: 4656 - DNA, 708 bp, Triticum aestivum
tcatcaatgattcaggttgctgctagaaatgcaatgaactggatttgatgtgttgagatccatggggctcatgcctatttgatcgatcagttcttcaaaggaccaagtcaatggacgcactgacaatacgcgggagcttagagaatcgttgccggtttggactagaagtagtcgaagccgtagtagatgaaatcggagctggtaaggttgggatgaggctctcgccctttgcaaactactgggaatcgtcagactccaacccgggagctctaggcctgtacatggcacacgcgctgaacaaaattgggatcctctactgtcacacggtcgagccacggatgataacgtttgttgacaaggttgaaactccaaatagccttcgcgccatgcgggatgctttcaagggaacgtttattgtagccggtggctacggcagagaggatggaaacgcagctgtctccagcggctatgctgatctggttgcatacggacgcttgttcttgtctaatcctgacctacctcggaggtttgagattgatgctccgctaaacaagtacaacagagatactttctacatctccgatccagttgttggatacactgactacccattcctttcatccgttgtataaatggttgttttataaatgggctcatccccgctctgaactatgatacccgggcgtattcattgttactgaacctgtt

SEQ ID NO: 4657 - DNA, 603 bp, Triticum aestivum
agtcaacgatcgcaccgacaaatacggtgggagcttagagaaccgttgccgctttgcgctagaagtagtccaggccgtagctgatgagattggagctgataaggtcggcataaggctttcaccctttgcaagttactcggatgcatcagactcaaacccagaagctctgggcctatacatggcacaggcgctgaacaagcttgggatcctctactgccacatggtggaaccacggatggtgaatattggagaaaagcttgagaccccgcacagccttcgcgccatgagggatgctttcaagggaacattcatcgtggctggtggatatggtagggatgatggagataaagcgatcgccgatggctatgctgatttggttgcatatgggcgcttgtttctgtccaatccagacttgccccggaggtttgagatagatggtcctctcaacaagtacaacagagatactttctacctctctgatccagttattggatacactgactacccatttctaccgtccgatatctgaacggacctttcatgaatgaatccctccttcctctcgtccgatcatttaccttacgtatcagaactatgttaatg

SEQ ID NO: 4658 - DNA, 580 bp, Triticum aestivum
tgggcgatggcggagctgatacggaacccgcgggttatgcggaaggcgcaagacgaggtccggcatcaactcgccgggcacgtacaaggtgaggtgtaggccgacctggcagatctgcgataccttgggtttgtcatcaaggagacgctgaggatgcacccgccggcgccattgctgctgccgcgtaggtgcgggagcccgtgtcaggttctgggcctggacgtgccggagggggtcatggtgatcgtgaacgcgtgggcgatcggcatggacccggcgcactgggaggcacccgaggagttcgcaccggagcggttcgagcagaacgggagggacttcaagggggcggacttcgagttcgtgccgttcggcggcgggaggaggatatgccccggcatggctttcgggctggcgcacgtggagctcgcgctcgcggcgctgctgttccacttcgactgggagctgccaggcggggcggcggccgaggatctggacatgaccaaggagtttggcgtcacggcacggctccggtctgaccttgtcgtggtcgccgtggccacggagtaaacgcacttttggt

SEQ ID NO: 4659 - DNA, 592 bp, Triticum aestivum
catcaccgagatcaccgagcaggacctggagcgcgtgttccgcaccaacatcttctcctacttcctcatggccaagttcgcggtgaagcacatgcggcccgggtccagcatcatcaacaccacctccgtgaacgcgtacaagggcaacgcgacgctgctggacacacggccaccaagggcgccatcgtggccttcacccgcgcgctgtctatgcagctggcggagaaggggatccgtgtcaacggcgtcgcgccggggcccatctggacgccgctcatcccggcctccttcccggaggagaaggtgaagcagttcgggtccgaggtgcccatgaagcgcgccgggcagcccagcgaggtcgcgcccagcttcgtcttcctggccagcgagcaggactcctccgagcatctccggccagatcctccaccccaacggtggcaccatcgtcaatagctagatcagggatagagaagatcgcgaagaacaagagtgaagtgtgtccgtggtgtggtgtgtggtatgtacgaggcaagtgcggcgtgtcgagtctcgagtgtcagctggtagtagttcggttgtgtgttcggtaggg

SEQ ID NO: 4660 - DNA, 568 bp, Triticum aestivum
gaagcacatgcggcccgggtccagcatcatcaacaccacctccgtgaacgcgtacaagggcaacgcgacgcttcttgactacacggccaccaagggcgccatcgtggccttcacccgcgcgctgtcgatgcagctggcggagaaggggatccgcgtcaacggcgtggcgccggggcccatctggacgccgctcatcccggcctccttcccggaggagaaggtgaagcagtttgggtccgaggtgcccatgaagcgcgccgggcagcccagcgaggtcgcgcccagctttgtcttcctggccagcgagcaggactcctcctacatctccggccagatcctccaccccaacggtggtaccatcgtcaatagctagatcgaggttggagaagctcgcgaagaacatagtgaagtgtgcctgtggtgtgtggtctacgagcaagtgtggcgtgtcgagtctcaaagagtgtcagctggtagtagtacggctgtgtgtgcggtaggggcttttggcgctgtagccgcgggaagcgtcaagcgttaaataaataatgtaacgtgcatgcaatgc

SEQ ID NO: 4661 - DNA, 628 bp, Triticum aestivum
cctaattataattaatttaagtacaatacatggattcgccttagcccactcactggagctatacttgattgtgacactcgagcacgtactaccctccgactgcatctcaatcggtttgacttcaccttctatcacagcccgatgacgttcctggaggtggtgacgccgccgtccacgacgaggttgtgcccggagatgtacctcgactcgtcgctggccaggaacagtgccgcctctgcgatgtccctggctctaagagtcgggcccttgagcgtcgccatgccccgcaccatctcctccgtcttctccacctcctccgcgctcaccggcgccggcagcgcgcccccttcctcgtcctcgccatgacgccacgcgttcaccagcattggcgtggccacgccgaagggggagacgcagttcacccggatgccgtgctccccgagctcgcaggccgcgttcttggtcagccccaccagcgcgtgcttcgacgccgtgtacgcgtgggggcccatcccgccgagcacgcccgccacgctcgccacggacacgatgctcccgccgccgcggcgcagaagcatggccgcgccgcgtgcttcatgccgagggccgcgccgagcgtgttcacgcc

SEQ ID NO: 4662 - DNA, 719 bp, Triticum aestivum
agtggaaaacccagtcacctcagttttggtccatgtactcttcatcatgctcgtcttctatccagaccttatccttcccaccatcttcctctacatgttcttgattgggctgtggaattatcggttcccggccacgtgtcccaccacatatgaacacaaggatatcctatgcggatgttgctcatccagacgagcttgatgaggaatttgacacgttcccaacctccaagagcgccgacctgattaggatgaggtatgacaggctacgacacgttgcaggcaggatacagacagttgttggcgacatcgcaactcagggtgagagattgcagtcactgctgagctggagggacccaagagcaacagccatgttcttattattttgcctcttcactgcaattatactgtatattacaccatttcaagtgatttcgctctgccttggcttcttctggatgaggcacccacggtttcgccacaaggtgcccgcagcgccagtaaacttcttcaggaggctacctgcaaagacggactcgttgctgtaaaggtccttggacatgagctaccaatgttatgttacacttctttgtatctatttactagtatgtaaactagtactgttgtacaatagctttaggtaatactaatatctattgttgttgttgtaccatgtgagacagcaaaataagtcgagttgataattttgtggttaaaagtta

SEQ ID NO: 4663 - DNA, 857 bp, Triticum aestivum
ggaaatgctacgccaccaggctgtgcagcttgttgcacagcgcctggggcgcatggaaccaccagttcgcagggaagttgttgagttcatgtcagacgcacgctctcacctgtggagcatgcgacgaagcaaagcaaacttcttccgtctgatgcaagtcttctctggattcattgctgcagggaagtggtttggtgacgtttgccagtggaaaaacccagtcaccacagtcttggtccatgtactcttcatcatgctcgtcttctatccagaccttatccttccgacgatcttcctctacatgttcttgattgggttgtggaattatcggttccggccacgtgtcccaccacatatgaacacaaggatatcttatgcggatgttgcgcatccagacgagcttgatgaggaatttgacacgttcccaacctcgaagagcgctgacctgattaggatgaggtatgacaggctacgacacgttgcaggcaggatacagacagttgttggcgacatcgcaactcagggtgagagattgcagtcactgctgagctggagggacccaagagcaacagctatgttcttattattttgcctgttcactgcaattatactgtatattacaccatttcaagtgattgcgctctgccttgggttcttctggatgaggcacccacggtttcgccacaaggtgcccgcagcgccagtaaacttcttcaggaggctacctgcaaagacagactcattgctgtaaaggtccttggacatgagctaccaatgttatgtcacagttctttgtatctatttactatgtaatactgttgtacaatggcattgggtaataatatctattgttgtac

SEQ ID NO: 4664 - DNA, 516 bp, Triticum aestivum
  misc_feature (73)..(73): n = any nucleotide
tctcatgtcccagcgctggtttactcatgcttcgccaacccttttcaatgctggcaccccgagacctcagttncgagcagctgtttccttatgcgtgcatgaaagatgatagcatcgagggaatctatgatactctgaaggaatgtgctgtcatcagcaaatctgctggagggattggcgtctctgttcacaacattcgtgctactgggagttacatccgaggaacaaatggaacatccaatggaattgttcctatgttacgtgtcttcaatgatactgctcgttatgtagatcaaggtggaggcaagagaaagggtgcctttgctgtatacctggagccctggcatgctgatattttcgagttccttgatttgaggaagaaccatgggaaggaggagaaccgcgcaagggatcttttctttgctctctgggttcctgatctattcatgcaaagagtacaaaataatgaggattggtacctgttttgtccaaatgaagcctccggggttggctgag

SEQ ID NO: 4665 - DNA, 691 bp, Triticum aestivum
aaatctcggagagaggagcaaaaagaaagatcccacgacagcgacgagtaggaggaggattcgtggcagacgtacgttgacgagcagctgctctgcggacatcgacggccagcgcctcaccgccgccgccatcctcgccacgacggcgccgtctgggcggagtctgagtccttccccaaggtcaaacctgaagaaattactgcagtaataaatgacttcgatgaaccaggctctttggcaccaactggattattccttggtggtacaaagtacatggttattcaaggtgaacctggggctgtcattcggggcaaaaaggggtcaggaggggttacaatcaagaagacgagtctggccatcatcattggaatttacgaggaaccaatgactcctggacagtgcaaacatggtggtggagaggctcggtgattaccttcttgagcagggcttctgaactcaagagtcctagtctgggccaactgggcttatgcctaccgaaatgtactaccgcataccccatgaataattggacacatccggatatgttttgaacaagtggaggttcctcgttatgttggaattgcttcctatatgtcatggggcttatatgtaacctttaaacgtcgtcatatttttgccgagcatccagtttttcctgttactgacatatcctgcaatgtatcaacatgcg

SEQ ID NO: 4666 - DNA, 832 bp, Triticum aestivum
aaagacccgttgttcctctgcgccggcgtggggagaactctgtcccccatcgtcgccgagctcaccggcctcggcctgttgcgttccgagatcgcgcgtctggtctcgctcgcccgcagcgacttccgccgcagagccatagtctccaacctgcagtactgcctgcatctcttcgggtccttccagaatctcttcagagtgctcaagaatggttcctaccttctgtcgtcggacctcgataagttggtcaagcccaatgttaccttcctgagggagtgcgggctaggtgattgtgatattgccaagctgtgtattgctgtgccgaggatgctgactaccaacccagagcaagaagaaatgccaaattttcaactactagcagaagaaataggaagttcacttggttaaatagaaccatggtccgcctaccttgaaattgatgtaccaggagcctaggaggatgccggtaggtgtttggttttggtgcaccaccaaaaaaagcttgctgatgggatgcaaaggctaaggtaatgaactatcaactgtacacgtgaggtagaaggctacgcctactgtactgccagctaaaatataatgcctattccatcaaaaagaaaaatgtaatgcctacctgaaccatcttagaaccgtgacttgtgttgatatttttagttccaacttcaaaatgatggctatactgttctgaatttttaggatatcagcagttgtttgtatctttgagtgtctaattccaagttgaaatcgagattgttaactgctgataagctgaaggtagtactaattgccatctttatttccgtttgacaaatag

SEQ ID NO: 4667 - DNA, 663 bp, Triticum aestivum
  misc_feature (450)..(475): n = any nucleotide
gcagagagcgtgtacaatgccgcactggcccttggcattgccaaccagctcacaaacatcctccgagacgtaggagaagactcaagaagggggagaatataccttccactggacgaactggcacaggcgggtctgacagaagaggacatattcagagggaaagtgacggataaatggaggaggttcatgaaggggcaaatccagcgcgccaggctcttctttgacgaggccgagaagggcgtcatgcatctagactccgcgagcagatggccggtcctggcatcgctgtggctgtacaggcagatcctggacgccatcgaggccaacgactacaacaacttcaccaagcgcgcgtacgtgggcaaggcaaagaagttcctgtctctaccggccgcgtacgcgagggcggctctctcgccatgagcaaagcaatcccgtagatcagatgtnnnnnnnnnnnnnnnnnnnnnnnnnntgtcctgtcaccctacaatgatttttgttggctgttgtatatactcagctatatgtttgccatacgcccgccgcggtatttaggtcaagggaccgacgtcgggccccgctgtactgaagtctgaaacacttgttgttaccacacagtggagaatcaaaattgctccagttgaatgaagaagaaacaaa

SEQ ID NO: 4668 - DNA, 771 bp, Triticum aestivum
  misc_feature (570)..(570): n = any nucleotide
  misc_feature (573)..(574): n = any nucleotide
atcgaggtatatgacctttgacgagctttacctctactgctactacgtcgctggcactgtcggtctcatgacggtaccggtgatggggattgctccggactcaaaggcctcagcagagagcgtgtacaatgccgcactggcccttggcattgccaaccagctcacaaacatcctccgagatgtaggagaagactcaaggagggggagaatataccttccactggacgaactggcacaggcgggtctgacagaagaggacatattcagagggaaagtgacggataaatggaggaggttcatgaagggccaaatccagcgcgccaggctcttctttgatgaggccgagaagggtgtcatgcatctagactctgcgagcagatggccggtcctggcatcgctgtggctgtacaggcagatcctggacgccatcgaggcgaacgactacaacaacttcaccaagcgggcttacgtgggcaaggcgaagaagtttctgtctctaccggcggcgtacgcgagggcggctctttcgccatgagcaaagcaatcctgtagatcagatgtttttttatnctnntttttctttcttattttgtcctgtcaccctacaatgattttttttggctgttgtatatattcagctgtatgtttgccatacgccctcgtcggtatttaggtcaagggaccgatgtcgggtcctgctgtactgaaagtctgaaacacttgttactaccacagtggagaatcaaaattgctccagttgaatgaagaaga

SEQ ID NO: 4669 - DNA, 518 bp, Triticum aestivum
agaggctcagcatcaggggccgcgtctacccggcgatcctgcccgtcgacggcagcaaagtccccgggaaggtttggaaggggatcactgacagggagctcgatgtgctggacatctttgaggatgaggagtatgtcagggaaactgttggcatctcgctgaccgattcggcggacacaatgatcgcctacgcatacatatgggggaatgtggatgatcctgacctctatggtgaatgggattttgatgaatggaagaaagtgcatctgaaggactatctcacaatgacacaagatttcaaggaggaactggaacagcttgaatctgagacacatgattgaagcttgccaatcattcttccagaaggattaattcgccaatttattgtatgtgctttgttcaaccagctctaatgtgaattgtaaataagatattcatcggattgccatcaacctagcaaaaaagaaaatagttttcatatcttgtgacgaccatagactcgagagtgttcaagtcta

SEQ ID NO: 4670 - DNA, 690 bp, Triticum aestivum
gaaaaccgagaaatcaaagacttcagacgcaaggactgcgtgcgatgtgggcgacggggtaaacgactcgccggccctgccgcagcggacgtgggcatggccatcggcgcgggcacggacgtggccatcgaggctgccgacatcgtcctgatgaagagcagcctggtggacgtgatcaccgccatcgacctctcgcggaagaccctcgccaagatccggctcaactacgtctgggccctgggctacaacgtcctgggcatgccgatcgccgctggcgtcctgttccctttcacgggcatccggctacctccctggctcgccggagcctgcatggcggcctcgtcggtgagcgtcgtctgctcgtcgctgctgctccagctctacaagaagccgttgcacgtcgaggacgtgccgataccagcaggacccggcgatggtggctcgaacctggtgtgaggagcacgcgcccgttctcgcggtgctactgacgaaactgttgctgtcaacgttagtgggctgcggctaattgctggcatgcatcaagccttgaactgacgcggattgaaaacgtgtggccctcctgattgattcgtgtgcatatgtaatttcacgcaaccattttccttcctttttgtgcggaatgattattttgataataatatgggaggttcatcctagaaacggaactat

SEQ ID NO: 4671 - DNA, 794 bp, Triticum aestivum
  misc_feature (646)..(646): n = any nucleotide
gtgaacgtctcctccaattatggactgctaagacatatcggcagcgaggaggtgaggcaggagctcaacgacgtcgacaacctgacagaggggaggctagacgagctgctggagaagttcatgaaagacttcgaggccggcgcgctggagccgcacgggtggcccacaaagttctcggcgtacaaggtggccaaggccgccatgaacgcctactcgaggatcctggcgaggaggcaccctgagctgcgcgtcaactgcgcgcaccctggcttcgtcaagaccgacatgagcatggggtccggggtcctgacgccggaggagggcgcacgtaacttggtgaaggtggcgctgctgcctgacggcgggccgaccggcgcgtatttcgccatgggcgaggaggcgccgttcgtgtgaggtaccggcggtacgtgcgtgcgtgccgtacggttactgcttggatgcgttaaaaaaaaataagatgtgtcatctatcttttttcgacaaagggtgaggttcacagcggcagcgtccgccacctccaatgcatgacacgtgttcagtgagggctcgtataccgtccttcattgaacgcgcttttgcaacagaggtaatgtttctgaaacatatgtgatattgcagtagtttncgacaagtctatgttctataacaaaacatcggtcgtgaaaattttctgcaaccatacctcagttgcaaaaaaaaaaattgcaacaagatcccagttgaaaaaaatgcaacaaagcatctgctgtaaaaaaattctgaaacaagaccta

SEQ ID NO: 4672 - DNA, 620 bp, Triticum aestivum
gcgtgcgacttcggcggtgccggcaccattgtcaaccaggcaccatcaggccgctgcgaccttagcccgagctggtgtgtcgcgaacgcagcggtgggcgccgcacggctgcagaacgcgctggactacgcctgcggtcatggcgcggactgcactgacatccaacctggagcacggtgcttcgatcccgacaccaaggtcgcccatgcgtccttcgcgttcaatgactattaccagcgccataaccaggccgccggaacgtgcgacttcgccggtgccggtaccattgtccggcaggcaccaaagataggcaactgcgtgctgccgtcaagggcctgaactgaagaaactgtagccaaagcgaagctttactaccacgagattaagcaataatcccgacagattattgtctgctgccggcaaagtctagttttcaaatgtaaaactgcatgcttttcatcaggtgcttagagcaagtacaataatgggcttatagcctggttacgtgtcacttttgcctatgtgaaaaggagtgatgtggaaaaatagtgggagaggactctcatatagagcctagctctatgcttactcctaggcaattgcaataaatatgaagaaag

SEQ ID NO: 4673 - DNA, 640 bp, Triticum aestivum
actactaccagaagaacggccagaccaacagcgcgtgcgacttcagtggtgctgccaccattgtcaaccaggcaccatcaggccggtgcgacccgagcccgagctggtgtgtggcgaacgcggcggtgggcgccgcgcggctgcagaatgcactggactacgcctgcggccacggcgcggactgcacggacatccaacccggagcacggtgcttcgatcccgacaccaaggtcgcgcatgcgtctttcgcgttcaatgactattaccagcgccatggccggggcgccggaacgtgcgccttcgccggtgccgctaccattgtccggcaggcaccaaagataggcaactgcgtgctgccgtcaagggcctgaactgaagaaactgtagccaaagcgaagctttactaccacgagattaagcaataatcccgacagattaccgtctgcggccggcaaagtctagttttcaaatgtaaaactagataaataaatccatggttttcatcaggtgcttagagtaagtacaataatgggcttatagcacggttacattacacttttgcctatgtgaaagagagtgatgtggaaaaatagtgagagaggactctcgtacaaagcctgagctatatgcttactcctag

SEQ ID NO: 4674 - DNA, 629 bp, Triticum aestivum
cgcctcgtcgcatcgggctcgaccccgctggccatcgcgtcgtatcccaaggcccccttctccaggccgcgggcggcgacgccatgtgttcgatctgcctctccgagtacatggacggcgagatgctacggctgatgcccgagtgcaggcacaggttccacgtcatgtgcctcgacgcctggctgcgcaggagcgcgtcgtgccccgtttgcagatcgtccccaatccccacgcccgtcaccacgccgctcgcgacgccactctcggagctcgtcccgctctcgcaatacgccgctgaccggcggcgcagcaggtgacgggtagtctacatgggtgcacctcgctgctcttcattgttactcctcttttttctttttgcgttgaaaagggttctgtaaatttgtcgattgtatgattggtaaggacacataaggagttttaggtgctagtacgactggtggtgtgcttaggatttgtaaagagttgcttggttcccattactattacttcgagaaaattttgtaatgtagaagtagatgacgggtttctcgaaaaaaaagtagatgttggagcaggcatagttgtgaatacagtgttgctggtttgccttattgtgaaatgttaaatta

SEQ ID NO: 4675 - DNA, 746 bp, Triticum aestivum
  misc_feature (646)..(670): n = any nucleotide
cacgccgcgagcggaggtttgcccgagccatggacgactccggctcgtgcttctcttccgggacaaggcgtacctccaccccgagaaggttgtggacctggtcagaaggcggtccgcttgcactcgcaccagacaacgacacgagacaggcagagtttaagcagctccaggaaaagaaggaagagatcgacaagctggcacacaagcaagtccggcgagtcctgtggactggcttagggttcttcatgctccaggttgggatcttcttccgtctcacgttctgggagttctcatgggacgtgatggagccgattgccttcttcacgaccacctcggggctgctggttggctatgcctacttcgtcatcacctcaagggacccgacgtatcaagacttcatggagaggatgtttgagtcgaggaggagaaagctttgcgtgaagcatggtttcaacatggagaagtacctggagctgcagaaacattgcaagtgccctctggaaggccatcattctcaggggcatgactcgcaacacctgagctaaagtttctcagttgtttcttgatgctgacagtgtcatctctagcttttagaagagcggccgtttgcattatcttatactgagtttgtattaccaaaagtcgnnnnnnnnnnnnnnnnnnnnnnnnnccagctgtcacctaacaggttaaacctaacagtttaagcttatttagccctgtgtgtatcaagtgggtgtgcgagc

SEQ ID NO: 4676 - DNA, 745 bp, Triticum aestivum
ttttaaataagcttaaactcttaggtttaacctgttaggcgacagctggtttatgtaaatatatatatatcactttggtaatacaaactcagtataagataatgcaaacggccgctcttctaaaagctagagatgacactgtcagcatcaagaaacaactgagaaacttcagctcaggtgttgcgagtcatgcccctgagaatgatggtcttccagagggcacttgcaatgtttctgcagctccaggtacttctccatgttgaaaccatgcttcacgcaaagctttctcctcctcgactcaaacatcctctccatgaagtcttgatacgtcgggtcccttgaggtgatgacgaagtaggcatagccaaccagcagccccgaggtggtcgtgaagaaggcgatcggctccatcacgtcccatgagaactcccagaacgtgagacggaagaagatcccaacctggatcatgaagaaccctaagccagtccacaggactcgccggacttgcttgtgtgccagcttgtcgatctcttccttcttttcctggagctgcttaaactcttcctttctcgtgtcgttgtctggtgcgagtgcaagcggcaccgcccttctgaccaggtccacaaccttctcggggtggaggtacgccttgtcccgaaagagaagcacgacgccagcgtcatccatggcccgggccagcacctccgcctcgccgcgcgtgcgggccgcgccgacctcgacgcag

SEQ ID NO: 4677 - DNA, 692 bp, Triticum aestivum
ctctgatgctgagctcccaaattgctgaagacttagctagagcatttactgagcggacaattttgcaaatatttttggaggatgagatgaatgctcctgctggttctttaaaggatgtattggggttactgaggtctatgtatgtaatggtgtgcatagacgaatctgcatcttttctgagatacggttatttgtcgcgggacaatgtagccaccgtgaggaaagaagtcatgatactgtgcagtgaactcaggccccatgcgcttgctattgtcgattctttcggaatccctgatgcctttctcagtccacttgctttcgactggatcgaagcaaatgctctatcttccgggagcgaatgactatacaccttcagacccccaatgaggacgtagccccgtaaatgttaaactattacagatggggcagccaaatgcagattactaaacaaagacaggtgcataatgcatttggtgcttcatgtggtttacacagtttataataatagttgttgaagtgtacagtcgaagatgctgatctgcgcagaaaatagggaatttggtgtatgcatcagttcatgtattgtcttgtctaaattacgccaataaaactgaataagctgatatggcccaggggctcactgttgtaaattagtgtacactattgtttgttttggtttttattctttcttt

SEQ ID NO: 4678 - DNA, 863 bp, Triticum aestivum
  misc_feature (128)..(128): n = any nucleotide
  misc_feature (160)..(160): n = any nucleotide
gggataaatcctgcctttatgttggctatgtgcatatggctagatggatttgtcctgcttgagggagcgggatttactgaaacagttcgcagaggaggtagctcgccatctggcacaaggggaaagcngagaaagggctctgatgctgagctcccaaatngctgaagacttagctagagcatttactgagcgcacaattttgcaaatatttttggaggacgagatgaatgctcctgctgggtctttaaaggatgtattggtgttactgaggtctatgtatgttatggtgtgcatagatgaatctgcatcttttctgagatatggttatttgtcgcgggacaatgtaaccaccgtgaggaaagaagtcatgatactgtgcagtgaactcaggccccatgcgcttgctattgtcggttctttcggaatccctgatgccttcctcagtccacttgctttcgactggatcgaagcaaatgctctatcttccgggagcgaatgactatacaccttcagacaccaatgaggacgtagccccgtaaatgtgaaactattacagatggggcagccaaatactgattactaaacaaagacaggtgcataatgcatttgctgcttcatgttgtttacacagtttacaataatagttgttgaagtgtacggtcgaagatgctgatctgcgcagaaaatagggaatttgatgtatgcatcagttcatgtattgtcttctctaaattacgccaataaaactgaataagctgatatggcctgacaggggctcacagcgtaaatagtgtacacaatgttgtttgctgtaaattctttcttttttgacatatgttgttgaaccgtacacaagcataagc

SEQ ID NO: 4679 - DNA, 671 bp, Triticum aestivum
gcgacaccgtttaaatcgctggacaatggcggacaagcttgagcctgtccataatgttcttgggagcagcacaaacccaagatgcctggatttagctatactgaacgtgacacagatgacggcacagcgaaaagatggtcacttgtcagtgtacatcagcccttcggggcctgtccccctgcgtagacaggattgcagccattggtgcttgcctggagttcctgatacctggaacgagcttgtgtacgccgtcttcatgaaaaggcaaacgatggtggaccaaaatgtttcccttgctgcttccagaacgctgaacacaagttgactaaaattctatgggtaggctacccgatgctcgcccggtgaagctttgtatctgaggttggttggtgatcctcctgcactatgattttgcaagataggagctggcttgtaggaagttgtaccactctaatctgttgtatgttgagaggagagtgcaaataagagcaaaattaaagaaaggcataccactatgtttcacagaggcagccaaagttttagccgatgtgatcatagattagaggggctgcattcgatgatgtacatagtttattactttatttggctgctgtcatattgggggagttaccgtggtgattgtatgtaattcaggaattttatcctcaaag

SEQ ID NO: 4680 - DNA, 655 bp, Triticum aestivum
gacatgacgcggggatggtggtttcgtctgctgcgctgatggagtatccgctctgggtgatgaacgtggtgccttcaggttctgctcctgacgccctcggtgttatctacgagcgggggttcattggaacgttccatgactggtgcgaggctttctcgacgtatcccaggacatatgacctcatccatgctgataaagtgttcagcttttatcaggacaggtgtgacataacatacatcctcctggagatggaccggattctgcggcctgaagggatggtgatcttcagggacaccgtggagatgttagtgaagatacaagccatcaccggtggcatgagatggaagagccagatcatggatcatgaatccgggccgttcaaccctgagaagatccttgtggccgtcaaaacttactggactggggagcctgcccaaaagcagcaatagtcgttcgacgtcatctcctgcaaaagtccagacagaaaacctttctgtcgagtcttcatcgactgttctctcttagcttcaggatatatctgtatatagtaggtgggcattcgctgtatcatcatcggtttaattttgtggtctcgactcgcaagctgcgttgcgttgttgcgagtagtgagtgtgacacggtgcgatggtgtata

SEQ ID NO: 4681 - DNA, 652 bp, Triticum aestivum
tgctgcgctgatggagtatccactctgggtgatgaatgtggtgccttcaggttctgctcctgatgccctcggtgttatctacgagcgggggttcatcgggacattccatgactggtgtgaggctttctcgacgtatcccaggacgtatgacctcatccatgctgataaagtgttcagcttttatcaggataggtgtgacataacatacattctcctggagatggaccggattctgcggcctgaagggacggtgatcttcagggacaccatggagatgttagtgaagatacaagccatcaccaatggcatgagatggaagagccagatcatggatcatgaatccgggccgttcaaccctgagaagatccttgtggccgtcaaaacttactggaccgcggagcctgcccaaaagcagcaatagctatcgccttcctcagtgttgttctatgtcgtctgctgctaaagttcaaacagaaaacctttctgttgagtcttcattgactgttctcttagcttcaggatatatctttagatagtaggtgggaattcgctgtatcatcatcggtttaattttgcggtctctgactcgtgagctgtgagtgtgacacggtgctacacgatggtattcagcaaccgttccaagaggatattc

SEQ ID NO: 4682 - DNA, 634 bp, Triticum aestivum
aggcaccagattaacagcaggactgtgaagataccgagaatgtgatgtgtatggatttggagttcttgtgctggaggtcatgacagggaggacaccagtggagtacatggaagatgatgttattgtactgtgtgatgtggtgagggctgctttggatgaaggcaaagtggaagagtgtgtcgatgagaagctctgcggaaaattcccactggaagaggcggttcctatcatgaaacttggcttagtttgtacttctcaggttccctccaataggccagacatgagtgaggtggtgaacaattggagttgatcagatgcccacaggacagcccagaggccgagttaggttaagctctatctcctttggcccccttctcgtcaggccttgtttcattttgggtatccttctttgcttggtagtcatttaagcattctatctagtgtgctttaggtagtaggagcagagtgccaagtgccaacctagtcttcgataggcaagaaattatgtactgtaatgcattccaacggtctcatggcctatggctgttgatgtgtttgactttgatcctcatcagtatgatgcctgttgtggatcctctcacatcagttttataagcatgagacttatttcaaa

SEQ ID NO: 4683 - DNA, 658 bp, Triticum aestivum
gataaccgagaaatgtgatgtgtatggatttggagttcttgtgctggaggtcatgacagggagggcaccagtggagtacatggaagatgatgttattgtactgtgtgatgtggtgagggctgctttggatgaaggcaaagtggaagagtgtgtcgatgagaagctctgcggaaaattcccactggaagaggctgttccgatcatgaaacttggcttagtctgtacttctcaggttccctccaataggccagacatgagtgaggtggtgaacatattggagttgatcagatgcccacaggacagcccagaagccgaattaggttaaggtctatctgctttggccctcttctcgttggggcttgtttcattttgggtatccttctttgcttggtaaccattaagcgacgaaagacaaggaagttctatctagtgtgctttaggtagtaggagcagaatggcaagtgccaacgctagtctttgataggcaagaaattatgtaatggattccaacggtctcatggcctatggctgttgatgtgtttgactttgatcctcatcagtatgatgtctgttgtggatcctctcacatcagttttataagcatgagacttatttcaaaagtattcgtatttttgtggtgtcttgtccacaagttgtc

SEQ ID NO: 4684 - DNA, 659 bp, Triticum aestivum
ggagacaatcctaaacctgggaaagcaactgaaagcacttgcatcgccaaaggatgccacctcggttcgtccagagcgaaaacctcggtccaagtcactgaatgagatgctagccgtcgacgacgggggatttgatgacctcagctccccgaagaccaaggagattatatgctcagaaataaggccaccacatgaaagaaaattttcggccgacgggggaggtgacgattcagaatcgtgttattctcacccagcaccggtggctccacccgccaagccttccgttgtgagcggaagctgcaagaaagaagccgccgccaaggccgtatcactagccgttgtcccaagcaagcagaaggggaaccccacttgctcaagaggatcctgacaggaaggaggagggatgccataatcaaccaaggtggtcctgagtgcttagctgacagagaccaagggtaactatatccatgataaattccatttccatgtgtaaattaagcgtgtatcagttacctgttgagctgtgtttcttgtcaggtttaggaagaaccatggagtgtggatgccgtgtatgtattacaagtattagtgtgctttgtagcgttgtggccagcattaccctgttccttaggtgtatgaacttgtgtttgctcttggat

SEQ ID NO: 4685 - DNA, 655 bp, Triticum aestivum
agcactgcatcgccaaagatgctacctcggttcgtccagagcgaaaacctcggtctaagtcactgaatgagatgctagccgtcgacgatgggggattcgatgacctcagctccccgaagaccaaggagattatatgctcagaaataaggccaccacatgaaagaaaattttctgccgaccagggaggtgacgattctgaattgtgttattctcacccaacaccagtggttccacccgccaaaccttacggtgtgagcggaacctgcaagaaagaagccactgccaaggccgtatcactagccgttgtcccaagcaagcacaaggggaaccccaacttgctcaagaggatcctgacaggaaggagaagggatgccataatcaagccaaaggtgatcctgagtgcctagctgacagagaccaagggtaactctatccatgataaattccatttccatgtgtaaattaagcgtgtatgtatcggttgcctgttgagctgtgtttcttgtcaggtttaggaagaaccatggagtgtggatgccgtgtatgtattacaagtatcagtgtgctttgtagcgttgtggccatcattaccctgctgcttaggtgtatgaacttgtgtttgctcttggatgtggctaatttatgagtagcatgc

SEQ ID NO: 4686 - DNA, 619 bp, Triticum aestivum
cgctggcaaacagtttaccaggcagcactcgtggcgaattcccttttcactacatgctacaagtacaacatgcaagtagagaatgcaagtgtccttttgttacttgccgaaatacatagaaagtccgacacgcggtccttggcctcccttacgcattagccagccaatcgttttgcaagtcgtttaatttggatctgcttgaagcttcagccacactcactcttgctgaactgtggctagctctcggatcaaaccacgcgaagagggcctcaagtcttgtttatcaaagccttcctatgatcctcggccatggcggtcttgagctgcgtgctcggtctcagatagtcttagcaaatgtcacttaacagatccagaattttcagtttctgaagatccctgtgctgttctggaccctctaaatcaagcggctgaagatctgcaggttttagagtaccacgagatggcggcagaggcgtactatctcaaggcgatgacgtataaccacctgggcaaggaatatgagagggaggaagctgcggtttgtttcaaggagcacgtcactgccctcgagaacccgtgcgacgaggaggattcacttgcttactgaccttgcacagtt

SEQ ID NO: 4687 - DNA, 673 bp, Triticum aestivum
caacatggcgcttgccctcgcctccccaatggcgtccctctcgctccactccgggaggatctcggcgctggctatcggcggcggtctccgcccccacaaggcgggccctatgggggcctccgcatccccgtttctccggagctcattcatctcctcttcctccacctcctccgcccccacctcctcgctctcggctgcggtctcggcgtcgctcgccttcacgtccgcctcctcgttcggcggttcatctttgggaattgagttcagctacaacagattaacaacacgcagaccccgcggtctacagattagggctggaaaggctgccctctgcctgaccaagaggtcaagatctaggaagtcacttgcccgtgtgcatggtttccgaaagcggatgcggactactgctggaagaaaggttctgaagcgtagacgtgacagaggaaggaagattctctgcacaaagtcgaactcacccactgggacaaagtattgattacagtgtaatgtgaggcattatgtattccagctgtaagtttactctttttgcaccccatgttctcagccatgttcatctgtaacaattgctgcacatcttttccctgtactttggttaataacttgatatctgaactaaattccgacactcgtgtaatttatcctttttggttgt

SEQ ID NO: 4688 - DNA, 684 bp, Triticum aestivum
  misc_feature (158)..(158): n = any nucleotide
  misc_feature (164)..(164): n = any nucleotide
gctgcacagacatggcgcttgccctcgcctccccaatggcgtccctctcgctccactccgggaggatctcggcggtggctatcggcggcggtccccgcccccacaaagcgggccctatgggggcctccgcctccccgtttctccggagctccttcatntcctcntcctccaccacctcctcgctctcggctgcggtctcggcgtcgctcgccttcacgtccgcctcgtcgttcggcggttcatctttgggaattgagttcagctacaacagattaacaacacgcagacctcgcggtctacagattagggccggaaaggctgccctctgcctgaccaagaggtcaagatccaggaagtcacttgcccgtgtgcatggtttccgaaggcggatgcggactactgctggaagaaaggttctgaagcgtaggcgtgacagaggaaggaagattctgtgcacaaagtcgaactcacccactgggacaaagtactgattacagcgcaatgtgaggcgttatgtattccagctgtaagttttactctttttgcaccccatgttctcagccatgttcatctgtaacaattgctgcacatcttttcgctgttactctggttgataacttgatacctgaattaagttccaacaccggtacaatttatcctttttggtagtggcagtctttaatg

SEQ ID NO: 4689 - DNA, 685 bp, Triticum aestivum
gagaaacaagaaggggtttccaatccttttgctggtcagatccagttaacttctttggaaaaggtcctcaagacggaatctaatggatactgatgtcaaccagaggaaaaatgttattacgagaggagtcctttcagtaactgttatatctgcagaggacataccagcaatggatgtgatggggaaggctgacccgtttgtcgtcctgtacctgaagaagggggaaaccaaaaagaagactagggttgtgactgagacgttaaatccgatatggaatcagacatttgattttgtagtagaagatgccctgcatgatttgctcattgtggaagtatgggaccatgatacatttggaaaggattacatagggagatgcatcttgacacttaccagggcgatactcgaaggcgagttccaagatacatatgtgctgcaaggtgctaaatctggaaagctgaacctgcacttcaggtggacggcacagccaatctaccgtgatcgtgacagggaccagtgaaacctgcatagcttcacacgataagactgccttcttcctctacgatgcctgtatattagcctttcaatacacggatccgcttgggtcttgtaagttgtaaccgtgtatagagactactttgtgattagtcataaatatcgttctacatatgtcccggataaatataaa

SEQ ID NO: 4690 - DNA, 665 bp, Triticum aestivum
gtacgtgcacctcgagaaccgtgccgctttcgtggagtaattgatgctatagtccatgagattggtcggatcgcgtaggcatcaggttgtctccattcgtggactacatggactgcttcgactcggacccacatgcactcgggatgtacatggtacaacagctcaacaagcatcaagggtttgtctattgccacatggtagaaccccggatggcaattgtggatggtcgcagacaaataccccacgggcttctgccattcaggaaagcattcaacggcactttcattgccgctggagggtatgatcgggaggaaggcaacaaagtggtggccgacggctatgctgatctcgttgcttatgggaggatctttctagctaatccagatttgccaagagattcgagctcgactcaccattgaacaagtacgaccgtaacactttctacacgcaagatcctgtcattggctacacagattatcctttccttgaaggcggctcgaatgccgagtagttcacccactcgacttgaattagtgatgtgcttgattttataaagtatgtaatgatttattcaatgtgtgtatgcacggggcatgtgcactgtatcattttcaccaataatttacttttgttttcccatgtaatgccatatgtcagatattatt

SEQ ID NO: 4691 - DNA, 661 bp, Triticum aestivum
ctttgttaaccaaccgcactgctgccgtccccgtctgcctccggccatcaaccatggcgaggagttccatggccgcggtgctcgccgtcctggccgtggcggcgctccggtgcgcgccggccgccgcggagtcccgctggtggagcacccggccaagaacgacgggtcgctcagcctgctcgtcatcggggactggggccgcaagggcacctacaaccaatccaggtcgcggagcagatggggaaggtcggggagaagctggacatcgacttcgtggtctccacctggcgacaacttctacgagaacggcctgacgggcgtccatgaccagcagtttgaagaatccttcaccaatatctacaccgccaagagcttgcagaagccgtggtacctcgttcttggaaaccatgactaccggggcgatgcggtagcacagcttgacccggtcctgcgcaagctcgatgagcgattcgtttgcatgagatcatttgttgtcaatgcagagatggtggagttcttcttcatcgacaccactccattccaactcaagtacgggactcaccgtgattctgtaacgggcaacaaccccttcaagccatggccatcaatccgcagctcgcacccaagatctcaagttagttgtcaggcatctttagcggtt

SEQ ID NO: 4692 - DNA, 777 bp, Triticum aestivum
ggagaggaaagagaggggacttggtccagaacaccaccccaacgacccccctcctctcccgtgttttctcctacttctcctcccggacggaggcttctcctctctcgccctgcttgattggagctgcccctcactccctctgtctccctgcgcgcacacgggattccaccattggcagaaagatcaaggtggcggcagtggcggcggcgagtagaggttccaccattggctagttcgtctcaaggagtagaattcttacatggtccctgtaaacaggaggggaacacagcctagggctgggatggagtactttgatgctaggcgtaaaccacataatattgggaaagtcgttgtggccctgctcttcgtagcactctgtatatttgttctgaagcaatctcctggttttggtggcaatagtgtgttttctcgtcatgaacctggggttacccatgtcttagtgacaggagtagctggctatattggttcacatgcctcattacagctattaaaagacaactatcgagttaccattgtggacaatctttctagaggaaataaaggagcagtaaaggttctccaagaattatttccggagcctgcgagacttcaattcatctatgcagatcttgcggatcaaaaatttgtcacaagatatttcttggaaatggtttgatggtctaaatcggagggacgcctaaagatcaagtacgtaggtgatggaagctagctttataggtcctaatcatatggggggtaaagtggtggaacggttca

SEQ ID NO: 4693 - DNA, 717 bp, Triticum aestivum
tacgagagcatgaagaatatctggacatgctttgatgcagcactaggagtcatttcaggattgaaggttaaagggatagattatccctacagctgatggaacctgcataagagactacattgatgtcacagatctagtagatgctcatgtgaaagcactcaacaaggcagagcctagtagagttggcatttataatgttggcactggaagaggccgttccgttaaggagtttgtcgatgcctgcaagcaggcaactggggttgacatcaaaattgagtacctcagcaggaggccaggagactatgctgaagtattcagtgaccccaccaagatcaacagtgagctcaactggactgctcaacacaccgatctgaaggaaagcctgtctgtcgcatggaggtggcaaagtcgcatccgcgtggctatggggcaaattagatatagctcgcaatcaataactccgctgaaaccgttaatacatgttgattctgtagttagtggtataggatcttggtgctctatactccttgccaagtcgcttcgttcttaatctgttcttttcttttttctgttttcaaaaggtttgttttttcctagtggaaatataagcgatccggatatgctggaaatcctgtaagcattcctgtaagagcaaattgcttgattgaaagaactgtgaagtacatttcttgtgccattcaaatctgatggttgtta

SEQ ID NO: 4694 - DNA, 702 bp, Triticum aestivum
ggcgcgaaatttgtactatgaagttaataaagcatcctaatgttgttcgactgcacgaggtgatgggaagtaaagcaagaattttcattgttctggaatacattactggaggggaactctttgataccatttataccaatggaaggctgaaagaagaggaagcacgcaaatactttcaacagctgataaacgccgttgactattgccacagtaggggtgtgtatcacagagatttgaagttagaaaatttgttgcttgatgctgctggaaacctcaaagtgtccgacttcggtttaagtgctttaactgagcaagtgaaggctgacgggttgctgcacacaacatgcggaactccgaactatgttgctcctgaggtgattgaggatagaggttatgatggtgcagctgcagatatctggtcttgcggggtaatcctttttattctccttgccgggtttttacctttcgaggatgaaaacatcatcgccctttataaaaagatctcagaagctcaattcacatgcccctcttggttttctactggagctaagaagttgattaccagaattttggaccctaatcctgcaactcgtatcaccattctcagatactggaggaccttggtccacaaggttcaagccactgttttgcgacagtttaactagttgaaaatttagccgcttggaccccagaccatttgaa

SEQ ID NO: 4695 - DNA, 853 bp, Triticum aestivum
agtcagtttccaagaacactgaactatgggcctgttgctatcaaatcctcgataaggagaagttcagaagctcagattggttgaacagattaggcgcgaaattttgtactatgaagttaataaagcatcctaatgttgttcgactgcacgaggtgatgggaagtaaagccagaatttttattgttctggaatacattactggaggggaactctttgataccatttataccaatggaaggttgaaagaagaggaagcacgcaaatactttcaacagctgataaacgctgttgactattgccacagtaggggtgtgtatcacagagatttgaagttagaaaatttgttgcttgatgctgctggaaatctcaaagtgtccgactttggtttaagtgctttaactgagcaagtgaaggctgatgggttgctgcacacaacatgcggaactccgaactatgttgctcctgaggtgattgaggatagaggttatgatggtgcagctgcagatatctggtcttgcggggtaatcctttttattctgcttgccgggtttttacctttcgaggatgaaaacatcatcgccctttataagaagatctcagaagctcaattcaaatgtccctcttggttttctactggagctaagaagctgatcaccagaattctggaccctaatcctgcaactcgtatcaccattcctcagatactggaggatccttggttcaaaaagggattcaagccacctgtttttgacgataagtatgaaactagctttgatgatgtctatgctgcatttggagactcagagaccagcatgtgaaagagcgactggcataagccacctcatgatactct

SEQ ID NO: 4696 - DNA, 913 bp, Triticum aestivum
atcgtgatttgaatcaccaaatcttttagtggacaaaaattgggttgttaaggtgtcagattttgggatgtcaaggttgaagcatcatacttttctttcctccaagtcgacagctggaacaccggagtggatggcaccagaggtcctgcgtaatgagccagctaatgagatgtgtgatgtctacagttttggagtaatcctgtgggaattagcaacgttgcgtgtaccttggagtgggctgaatccaatgcaagtcgtcggagcagttgggttccagaacaaacgactagacattcccaaagaggtcgacccactggttgctagcataatatcttcatgttgggacaacgacccaagcaaacgaccatcgttctcccagctcttgtcaccgctaaagaaattacagcggctacttgttacagaaagcctctgacaatttgtgagacaaatatctggataaacgcaaaaaaaagaagaaaaatatgagtatttatgctactacatggaccaagtttttcatgttgaagcccgtggagatatattcaagatctctgctgtatggatgcgtatggacaaaggttctgcacatccttttgtgaaaattgtctgcagcagcgcgaaggtggtgctgaagaaagcgtagcgtgttagttccaagtgaagaaaatgtggcgcaacacgaagtgctctgtgccatggtaaataattgttcagttctgtatttggagcggggtgggggtggttctgagaatcagaattcactacaaagataggatcttgatttttgttggtttaaacagaaaatgttgaggaaaaaaagggaaccaaaagttttttatgtccgcaaaaagtgcaggcttatatttagcacatgcaaccttgatgtcatgatgcagatttactacgtctcaag

SEQ ID NO: 4697 - DNA, 881 bp, Triticum aestivum
ccaaatctcttcccccagcgcgacaagcaatcaccaccgcagcgagcgaatcggccgctttgcacgcagcgaggaacccaccagatcttcccccaatttcgcgtcgacaagtagcagcggagacggccatggcgtcggacgtgcagatgggcggcggcgcggcggaggcggagaccttcgcgttccaggcggagatcaaccagctgctctcgctcatcatcaacaccttctactccaacaaggagatcttcctccgcgagctcatctccaactcgtcagacgcgcttgacaagatccggttcgagagcctgacggacaagagcaagctcgacgcgcagccggagctcttcatccgcctcgtccccgacaagcccagcaagacgctctccatcatagacagcggcgtcggcatgaccaagtcagacctggtgaacaacctgggcaccatcgcgcgctccggcaccaaggagttcatggaggcgctgcaggcgggcgcggacgtgagcatgatcggccagttcggggtgggattctactcggcctacctcgtggccgagaaggtggtggtcaccaccaagcacaacgacgacgagcagtacgtgtgggagtcgcaggccggcggctccttcaccgtcacgctcgacacggagggcgagcggctcggccggggcaccaagatcacgctcttcctcaaggacgaccagctcgagtacctggaggagcgccgcctcaaggacctcgtcaagaagcactcggagttcatcagctaccccatctacctatggaccgagaagaccaccgagaaggagatcagcgacgacgaagatgaagtatcggatgagaagaaggagggtgaggtcgaggaggtcaacgacgactcc

SEQ ID NO: 4698 - DNA, 261 bp, Triticum aestivum
cgaatctgatccgaatagctggctcaagtataccgtggctcctgcgatgcagcctacggagttggttgatccctacctgcagtctccgacagcaactccgtcagtgaagtcggagtgtgtgtcgccaaggaacagcggtctcttggaagagctgcttcatgaagctcagggactaagatctgggaagaatcagcagctttccgtgaggagttcaagttcctctgtcagtacgccgtgtgatactacggtggttagccagag

SEQ ID NO: 4699 - DNA, 662 bp, Triticum aestivum
catcacggtgatgtccaagagcatttgttggagttcgcgtgggggttggccaacaaccgtacgccttcctgtggaaacgtgcggccagacctcgtcaagggcgacgacgaggccgcactaccgccagagtttttcgcggcgaccgagggtcggagcatgctctcgacgtggtgcccgcaggagaaggtgctggagcacgaggccgtagggatcttcctcacgcactctgggtggaactcgtcgctggagggcatatgcggcggcattccgatggtgtgttggcccttctttgctgagcagcagaccaactgccgctacaagtgcacggagtggggcatcgggatggagattggggaagacgtgagaaggaccgaggtggaggccatgatacgggaggccatggagggggcgaaggggcgagagatgcgacggcgtgtgcaagagctccgggatagcgccctggcctccgcacggtgtgacggaaggtccatgcgcaatgttgataggctcatccatgaggtgcttctcgcttgaaacaagaaaattaagctgataaataaaaggccttggactgtctgaagcgtttattaggatgaaatcaatcccttctccatttcaaagtttcagtcactattttgagcggttagttgaatatgttacca

SEQ ID NO: 4700 - DNA, 688 bp, Triticum aestivum
acgcgggtcacccacgccgtgctcccgggcatggtcgacaggaagcgtggcgcaatcgtcaacatcggctccggtgctgcctccgtcgtgccgtccgatccactctactccgtctaccccgccaccaaagcgtacgtcgaccagttctcaagatgcctctatgttgagtacaagggcaagggcatcgatgtgcaatgccaggtgcccttgtacgtggcgacaaagatggcatcaatcaggagatcctccttccttgtgccatccgcggacacctatgctcgtgctgctattcgccacattggctatgagccgaggtgcacaccgtactggccacactctgttttgtggttcttgatttccctcctcccagagtcgctcgtggacagtacgcgcctcagcatgtgcatcaaaatccgcaagaaggggcaggctaaggatgccaagaagaaagcgcagtgatggttccgatgcttgttgattgttgagatctgccaatgtttcttcatcatgtgtaatggactagtacttgtagctttgttgtcggcatttcagtatcattacctcccatcacactaggttgggactgttgttgttccttccacggttacgaagcacaagcctgtaataccttatctccaaatgaatgtaacgccagctgcactcaaggtgaaattgaaactaactaatt

SEQ ID NO: 4701 - DNA, 828 bp, Triticum aestivum
actccatccgggcttcgacgtcggcgtgctcgtcaactacgccggggtctcgtacccgtacgcccgcttacttccatgaggtggacgaggagcctcatgcggagcctcatccgggtcaacgtcgaggggttaacgcgggtcacccacgccgtgctcccgggcatggtcgacaggaagcgtggcgcaatcgtcaacatcggctccggtgctgcctctgttgtgccgtccgatccactctactccgtctacgccgccacgaaagcgtacgttgaccagttctcaagatgcctctatgttgagtacaagggcaagggcattgatgtgcaatgccaggtgcccttgtacgtggcgacaaagatggcatcaatcaggaggtcttccttccttgtgccatccgcggacacctatgctcgtgctgctattcgccacattggctatgagccgaggtgcacaccgtactggccacactctgttctgtggttcttgatctcccttctcccagagtcacttgtggatagtacacgcctcagcatgtgcatcaagatccgcaagaaggggcaggctaaggatgccaagaagaaagcgcagtgatgattccgctgctagttcattgttgagatctgccatgtttcttcattatgtgtaatggactagtacttgtagctctgttgtcggcatttcagtatcattaccttcccatcacactaggttgagactgttgttgttcgttccacggttacgaaagcacaagcctgtaatactttatctccaaatgaatgtaacgccagctgcactaaaggtgaaaatgaaactaactaaattttttgc

SEQ ID NO: 4702 - DNA, 546 bp, Triticum aestivum
caggaagcgtggtgcaatcgtcaacatcggctccggtgctgcctctgttgtgccgtccgatccactctactccgtctacgccgccaccaaagcgtacgttgaccagttctcaagatgcctctatgttgaatacaagggcaagggcatcgatgtgcaatgccaggtgcccttgtacgtggcgacgaagatggcatcaatcaggaggtcttccttccttgtgccatccgcggacacctatgctcgtgctgctattcgccacattggctatgaaccaaggtgcacaccgtactggccacactctgttctgtggttcttgatctcccttctcccagagtcacttgtggatagtacacgcctcagcatgtgcatcaagatccgcaagaaggggcaggctaaggatgccaaaaagaaatcgcagtgatgattccgctgctagttcattgttgagatctaccatgtttcttcatcatgtgtaatggactagtacttgtagctctgttgtcggcatttcagtatcattacgttcccatcacactaggttgagac

SEQ ID NO: 4703 - DNA, 758 bp, Triticum aestivum
catacgtaacggcgttaaatgaagatcctgagcaatacagggctgagcacaaaggatggaagagtgggcacgctcacaaaatggtaacttgtttagttgaattttcttccagagatggggaaatagagtccattctgaaagatatatcagaaagggcccagggtaagggaaacttcagctacagccggttctttgctgttggcttgttccgtttgcttgagctctcaaatgcgacggagccaaccgtactggacaagctttgtgctgctctaaacatcaataaaaagagcgtggatagagaccttgacgtttaccgcaacttactctcgaaactggttcaagccaaggaacttctcaaggaatacatcgagagggaaaagaagaagagagaggagagattggagacgcccaagccgaatgaggctgttgcaaaattcgatggaagcgcttatcccttgaagcattaactcaacctttccccagaggacagcttgtccggataacagatattaacagttatacacatctggatagcgttgagaactattgggggcatctttggctgctcttcgcccgagtgtagtactcggccgtacaaaaagatccagattattcgtagtattgagtttggtattttgtaatttctccttctatgtgttcgaatgttatcgttttcttcacttctttgacaatatatgaagaggtatctggtgatgaatgttacaagatgagaaaaaatatatattttggctgaaaaa

SEQ ID NO: 4704 - DNA, 718 bp, Triticum aestivum
aagtcatacgtaacggcgttaaatgaagatccctgagcaatacagggctgatgcacaaaggatggaagagtggcacgctcacaaaatggtaacttgttagttgaattttcttccagagatggggaaatagagtccattctgaaagatatatcagaaagggcccagggtaagggaaacttcagctacagccggttctttgctgttggcttgttccgtttgcttgagctctcaaatgcgacggagccaaccgtactggacaagctttgtgctgctctaaacatcaataaaaagagcgtggatagagaccttgacgtttaccgcaacttactctcgaaattggttcaagccaaggaacttctcaaggaatacatcgagagggaaaagaagaagagagaggagagattggagacgcccaagccgaatgaggctgttgcaaaattcgatggaagcgcttatcccttgaagcattaactcaacctttccccagaggacagcttgtccggataacagatattaacagttatacgcatctggatagcgttgagaactatcgggggcatctttggctgctcttcgcgcgagtgtagtacattattcgtagtattgagtttggtattttgtaatttctccttctctgtgtttgaatgtatcgttttcttcacttctttgacaatatatgaagaggtatctggtgatgaatgttacaagatgaggaaaa

SEQ ID NO: 4705 - DNA, 706 bp, Triticum aestivum
caggctgatgcacaaaggaatggaagagtgggcacgctcacaaaatggtaacttgttagttgaattttcttccagagatggggaaatagagtccattctgaaagatatatcagaaagggcccagggtaagggaaacttcagctacagccggttctttgctgttggcttgttccgtttgcttgagctctcaaatgcgacggagccaaccgtactggacaagctttgtgctgctctaaacatcaataaaaagagcgtggatagagaccttgacgtttaccgcaacttactctcgaaattggttcaagccaaggaacttctcaaggaatacatcgagagggaaaagaagaagagagaggagagattggagacgcccaagccgaatgaggctgttgcaaaattcgatggaagcgcttatcccttgaagcattaactcaacctttccccagaggacagcttgtccggataacagatattaacagttatacacatctggatagcgttgagaactatcgggggcatctttggctgctcttcgcgcgagtgtagtactccgccgtacaaaaagatccagattattcgtagtattgagtttggtattttgtaatttctccttgtctgtgttcgaatggatcgttttcttcacttatttgacaatatatgaaagaggtatctggtgatgaatgttactcacaagatgagaaaatta

SEQ ID NO: 4706 - DNA, 739 bp, Triticum aestivum
tcttaaagggagagttggcccccaaaaccatccatgtaccatcaggggagaagcttctgtttttgatgctgctatgaaatacaagaacgaagggcatgacactatcatcctggctggtgctgagtatggcagtggaagctcaagggattgggctgcgaagggtccaatgcttcagggagtgaaggctgtgatagccaagagttttgagaggattcaccgtagcaatctcgctggaatgggcatcgtccctctatgcttcaaggctggggaggatgccgacactcttggcttaacaggccatgagcgctacaccatccagcttccgactgatgtgaatgaaatcaagcctggccaagatgttacggtcacaaccgacaacggcaagtcgttcacgtgcacactccgctttgacactgaggtggagcttgcttactacacccatggtggtattctaccatatgtcatcagaaagatcgcagccgagcaatagagagatgattgcgacgacgaggcaaattgtaattgttgtaaacagtttgtttagcaagtcctgtttgaggagtaccccctcaaataacgtctgagatgtcggcagagaactcggaaattttgagcgcgtaacacgctaggtttttgtttgaaggcactactatgttaataatatgcctcacaactgatgagatgcttttgcatattgtaacggtctatgaacactgaagtggatcagccgaaggaatgt

SEQ ID NO: 4707 - DNA, 780 bp, Triticum aestivum
gttcttgaagggagagttggccccaaaccgtccatgttccatcaggggagaagcttgctgtttttgatgctgctatgaaatacaagaatgaagggcatgacactatcatcctggctggtgctgagtatggcagtggaagctcaagggattgggctgcaaagggtccaatgcttcagggagtgaaggccgtgatagccaagagttttgagaggattcaccgtagcaatcttgctggaatgggcatcgtccctctatgcttcaaggctggggaggatgccgacagtcttggcttaactggccatgagcgttacaccatccagcttccgactgatgtgaatgaaatcaagcctggccaagatgttacagtcacaaccgacaacggcaagtcgttcacgtgcacactccgctttgacaccgaggtggagcttgcttactacacccatggtggtattctaccatatgtcatcagaaagattgcagccgagcaatagagagatgattgtgacgacgaggcaacttgtaattgttgtaaacagtttgtttagcaagtcgtgtttgaggagtaccccctcaaataacatctgagatgtctgcagagaactcggaaattttgagcgcgtaacacgctaggttttcgtttgaaggcactatgttaataatatgcctcacaactgatgagatgcttttgcatattgtaacggtctatgaacaatgaggtggaatcagccgaaggaatgtccacattgttttctctttcctgggttattttctggtaacccc

SEQ ID NO: 4708 - DNA, 872 bp, Triticum aestivum
  misc_feature (771)..(771): n = any nucleotide
  misc_feature (779)..(779): n = any nucleotide
  misc_feature (803)..(803): n = any nucleotide
  misc_feature (848)..(848): n = any nucleotide
catcaggggagaagcttgctgtttttgatgctgctatgaaatacaagaacgaagggcatgacactatcatcctggctggtgctgagtatggcagtggaagctcaagggattgggctgcgaagggtccaatgcttcagggagtgaaggctgtgatagccaagagttttgagaggattcaccgtagcaatctcgctggaatgggcatcgtccctctatgcttcaaggctggggaggatgccgacactcttggcttaacaggccatgagcgctacaccatccagcttccgactgatgtgaatgaaatcaagcctggccaagatgttacggtcacaaccgacaacggcaagtcgttcacctgcacactccgctttgacactgaggtggagcttgcttactacacccatggtggtattctaccatatgtcatccgaaagatcgcagccgagcaatagagagatgattgcgacgacgaggcaaattgtaattgttgtaaacagtttgtttagcaagtcctgtttgaggagtaccccctcaaataacatctgagatgtctgcagagaactcggaaattttgagcgcgtaacacgctaggtttttgtttgaaggcactatgttaataatatgcctcacaactgatgagatgcttttgcatattgtaacggtctatgaacactgaggtggaatcagccgaaggaatgtccacattgttttctctgttcgtgggttatctttctggtccttttttttgggtagcttcttttggtaaccccngaatgatntgtctattgttttaattgtgcacnccgagttttgtcatctgatcatctgcttttggatgactagattcngcaaaacctggtgatggtagtaag

SEQ ID NO: 4709 - DNA, 1290 bp, Oryza sativa
atggcgggcgcggtgtcggcgctgttccttctggacatcaagggccgcgtcctcgtctggcgcgactaccgcggcgacgtctccgccctccaggctgagcgcttcttcaccaagctcctcgacaaggagggcgactcggaggcgcactcgccggtggtctacgacgatgccggggtcacctacatgttcatccagcacaacaacgtgttcctactaaccgcctcccgccagaactgcaacgccgccagcatcctcctcttcctccaccgcgtcgttgatgtgttcaagcactatttcgaagagttggaggaagagtcgctgagggataactttgtcgttgtgtatgagttgcttgatgaaatgatggattttgggtacccacaatacacggaggcgaaaatcttaagtgaattcattaagacggatgcgtacaggatggaggtatcacagaggccacctatggcagtgacaaatgccgtgtcatggcggagtgagggtattcggtacaagaagaatgaagtgttcttggatgttgtggagagtgttaacattcttgttaacagcaatgggcagattgtgagatcagatgttgttggggcactgaagatgcggacatatttgagtggaatgcctgagtgcaaacttggattgaacgatagggttcttttggaggctcaaggccgagctactaaaggaaaagcaatagatcttgatgatattaaatttcaccagtgcgtgaggttggctagatttgagaatgatagaactatatccttcatacctcctgacggatctttcgatctaatgacatacagacttagcacccaggtaaaaccacttatctgggtggaagcacaaattgagaaacattcaagaagccgaatagaacttatggtgaaagcaagaagtcagtttaaggaaaggagcacagcaacaaatgttgaaattgaagtgcctgttccttcagatgctacgaaccctaatataagaacttcaatgggctctgctgcatatgcacctgagagagatgcaatggtctggaaagtaaaatcatttcctggtggcaaggattacatgtgcagagctgaatttagtcttccaagtataactgcagaagaagcagctcctgaaaagaaggcaccaatacgagtgaaatttgagataccatatttcactgtgtcgggtattcaggttcgctatctgaagatcattgaaaagagtgggtaccaggcgcttccttgggttagatacattacaatggctggtgaatacgaactgagacttatatga

SEQ ID NO: 4710 - DNA, 567 bp, Oryza sativa; identical to SEQ ID NO: 391

SEQ ID NO: 4711 - DNA, 870 bp, Oryza sativa
atggccgcgcgcgtgctccccctcctcctcgtcgtcgtcgtcgccgcggccatggcgagagcccccacggcccacgcgtggggcaaggagggccactacatggtgtgcaagatcgccgagggtttcctgacgaaggaggcggcgacggcggtgaaggagctcctccccgggtgggccggcggcgagctcgcggaaacgtgctcgtgggcggacaccgagcggttccggtaccggtggtcgagccccctccacttcgccgacacccccggcgactgccagttcaactacgcccgggattgccacaacacaaacggtgagaaggacatgtgtgtggtcggagcgatcaacaactacaccaacgcgctcgaggactcatcaagtccatatgatccaaccgagagcttgatgttcttggcacacttcgtcggcgacgttcaccagcctctccactgcggccacgtcaaagatcttggtggcaacaccatcatcgtccattggtacacaaggaagagcaaccttcatcacgtgtgggatgtgaacgtcattgaaacggccttgaaggaattctacaacgaggacgtgagcacgatgataaaggccatcaagatgaacatcactgatgagtggtccaccgaggagaagcagtgggagacttgccgtagccggacaaagacttgtgccgataagtacgccgaggagagtgcaaagctcgcgtgcaaagcgtacgagggtgttgagcaagaatccaccttagaagatgactatttcttcgctgccctgcctgttgttcagaagaggattgctcaaggtggcgtgaggcttgctgcaatactcaaccggatcttcagcgggaacaaggttcagagtagt

SEQ ID NO: 4712 - DNA, 1308 bp, Oryza sativa
atgccgccgttcgactacacgccgccgccgtacgacgggccgcgggcggaggagatctcccggaagcgggccgagttcctcagcccctccctcttccacttctacgaccgccctttgaacatagtcgatgggaaaatgcagtacctgttcgacgaggatggccgccgttacctggatgcttttggtggcattgcaaccgtttgttgcgggcactgccatccggatgttgttgaggcgatggtcaaccaagcaaagaggatacaacactccacagttctttacctgaatcatgctattgcagattttgccgaggcattggcagccaaaatgcctggtgatctgaaggttgttttcttcacaaattctggcacggaggcgaacgagcttgcactgatgattgcccggctttacactggttgccatgacattatttcactcaggaatggataccacgggaatgcggctggaacaatgggtgctaccgctcaatgcaactggaaatttaatgttgttcagacgggagtgcaccatgcacttaatccagacccatatagaggtgctttcggttctgatggcgaaaagtatgcccgagatgttcaggaaatcattgattttggaactacaggaagggtcggtggtttcatttcggaagccatacagggagtgggtggaatagtggaactggcaccaggatacttgcctgctgtgtacaatatggtaaggaaagctggcggcctctgcatcgccgacgaagttcaggcgggagtcgcacgaactggaagccacttctggggatttgaatcgcacggcgtcatcccagacatagttacaatggcaaagggtataggcaatggcataccgatcggagcagtcgtcacaacccctgagatcgctcaggtgttaacccgcaggagctacttcaacaccttcggtggcaaccctgtcagcacagccggtggccatgctgttctcaaggttctggagaaggagaagctccaggagaacgcatttgtggttggctcctacctgaaggaacggctcaacaagctgaaagagaagcatgacatcattggtgatgttagagggaaaggcttccttcttggggttgagctggtgaccgatcgccagaagaagacaccggccaaagttgagatcggtcatgtcatgaaccacatgaaagacatgggtgtgctggttgggaaaggtggtttctacgggaacgtgttcagagtaacacctccactatgcttcaccaaagaggactccgatttcttcattgaggcgatggacatttcactatcgaagctg

SEQ ID NO: 4713 - DNA, 750 bp, Oryza sativa
atgccgatccgcaacatcgccgtggggagccaccaggaggtgtaccacccgggtgcactcaaggcggcgttggccgagttcatctccaccctcatcttcgtcttcgccggccagggctccggcatggccttcagcaagctgaccggcggcggagcgacgacccccgccgggctgatcgcggcggcggtggcccacgccttcgccctgttcgtggcggtgtccgtcggcgccaacatctccggcggccacgtgaacccggccgtgaccttcggcgccttcgtcggcggcaacatcaccctgttccgcggcctcctctactggatcgcccagctcctgggctccaccgtggcgtgcttcctcctccgcttctccaccggcgggctcgccaccggcaccttcggcctgaccggcgtctccgtgtgggaggccctggtgctggagatcgtaatgaccttcggcctcgtttaccccgtgtacgccccccccgttgaccccaaaaagggcagccttggcaccattgcccccatcgccatggggtttattgtgggggggaacatccttgttggcggggggtttgacggggcctccatgaaaccggccgtttcctttgggccggcccttgtcagatggtcctgggagtcccagtgggtgtactgggttggccccctcatcggcgggggcctccccggggtcatttacaaggtccttttttttttccccacccccgagcaggtccccccccccgactat

SEQ ID NO: 4714 - DNA, 423 bp, Oryza sativa
atgggtcgcgtgcggaccaagacggtgaagaagacctcgaggcaggtgatcgagaagtactactcgcggatgacgctcgacttccacaccaacaagaaggtgctcgaggaggtgtccatcctgccgtcgaagcggctgcgcaacaaggtggccgggttcaccacccacctgatgcgccgcatccagcgcgggcccgtgcggggcatctcgctgaagctgcaggaggaggagcgcgagcgccgcatggacttcgtcccggagaagtcggcgctcgaggtggaggagatccgcgtcgacaaggagaccatggagatgctcgccgcgctcggcatggccgacctccccggcgtcgagcgccagcaagaggtctccgcgccgacctactcccgcccgccgtacggtggcccccgccgcgaccgcgtc

SEQ ID NO: 4715 - DNA, 1947 bp, Oryza sativa
atggcgggcaagggcgagggtccggccatcggcatcgaccttggcacgacctactcgtgcgtgggcgtttggcagcacgaccgcgtggagatcatcgccaacgaccagggcaaccgcaccaccccctcctacgtcggcttcaccgactccgagaggctcatcggagatgctgccaagaaccaggtcgccatgaaccccatcaacaccgtctttgatgccaagcgtctcattggcaggaggtttagcgatgcttctgttcagagtgacattaagctctggcccttcaaggtgattgctggacctggtgacaagcctatgattgttgtccagtacaagggtgaggagaagcagtttgctgcagaagagatctcctccatggtcctcatcaagatgcgtgagattgctgaggcctaccttggcaccaccatcaagaatgccgttgtcactgttcctgcctacttcaatgactcccagaggcaggccaccaaggatgctggagtgattgctggtctcaatgtcatgcgtatcatcaacgagccgactgctgcagctattgcctatggtcttgataagaaggccaccagcgttggtgagaagaatgtcctcatctttgaccttggaggtggtacctttgatgtctccctccttaccattgaggagggtatctttgaggtcaaggccacagctggtgacacccatcttggtggtgaagattttgacaatcgtatggtcaaccactttgtgcaagaattcaagaggaagaacaagaaggatatcactggcaaccccagggctctcaggaggttgaggacagcttgtgagagggcaaagaggaccctgtcctccactgcccagaccaccattgagatcgattccctgtatgagggcatcgacttctactcaaccatcacccgtgccaggtttgaggagctcaacatggatctcttcaggaagtgtatggagcctgtggagaagtgcctcagggatgctaagatggacaagagctctgttcatgatgttgtccttgttggtggctccactaggatcccgagggtgcagcagctcctgcaggatttcttcaacggcaaggagctttgcaagaacatcaacccagatgaggctgttgcttatggtgctgctgtccaggctgccatcttgagtggtgagggcaacgagaaggtccaggacctcctcctgttggatgttacccctctctctctcggtttggagactgctggtggtgtcatgaccgttttgatcccaaggaacaccaccattcccaccaagaaggagcaggtcttctccacctactccgacaaccagcctggtgtgctcatccaggtttatgagggtgagaggaccaggacacgtgacaacaacctgctggggaagtttgagctctctggaatccctcctgctcccaggggtgttccacagatcactgtttgcttcgacattgatgccaatggtatcctgaacgtgtctgctgaggacaagaccaccgggcagaagaacaagatcaccattaccaacgacaagggcaggcttagcaaggaggagattgagaagatggtccaggaggccgagaagtacaagtcagaggatgaggagcacaagaagaaggtggagtccaagaacgcgctggagaactacgcctacaacatgcgcaacaccatcaaggatgagaagatcgcctcgaagctcccggcagcggacaagaagaagatcgaggatgccatcgaccaggccatccagtggctggacggcaaccagctcgctgaggctgatgagttcgatgacaagatgaaggagctggagggcatctgcaaccccatcatcgccaagatgtaccagggcgctggcgcggacatggccggcggcatggacgaggacgatgctcccccggctggcggcagcggtgctggccccaagatcgaggaggtcgac

SEQ ID NO: 4716 - DNA, 1719 bp, Oryza sativa
atggatctcctccagtcgtcctacacgccggacgacgaggacgacgacgagcagcagcccctctcctcgccggacgcctcgccgctccgcctccccgccaagtcggccgcccccgccgtcgacgacacggcgctcgcgctctccgccgccgccgcgtccacctcccgcccgctcgacccctccctccacctcgtcccctttaaccccaccgccgaccagctctgggcgcccgtcctcgggccccagcacccccacgcccccatctcctccgcctccggcaaccgcaaccacaagctcggccacgtcgaggacgccgccgtcctccccttcctcttcgacgagcagtacaacaccttccaccgcttcggctacgccgccgacccctccggcctccacatcgtcggcgacgcccagccctcggccgagcccgacaccgtctacaacctcgccccctccgagcacaagcgccgccgcctgcagtccaaggacgaggagggcgccaaccaggagcccctaccgccggaggccaagaacccggcgtccgacgagtggatcctccgcaacaagcagagcccctgggccggcaagaaggaggcaccacccgcggagctcactgaagagcagcgtcagtatgcggaggcgcacgctgccaagaaggccgagaaggaggcgcgcggcgaagggaagggcgagaagtctgatatggttgccaagagtactttccatgggaaggaggagagggattaccaaggacggtcatggatcacaccgcccaaggatgccaaggcgagcaacgagcgctgctatattcccaagaggtgtgtgcacgagtgggttgggcacaccaagggggtctcggcgattaggtttttccccaagtatggacaccttttgctgtctgcgagtatggattgtaagattaagatctgggatgtgctcgagtcgaggacatgtatgcggacgtacatggggcactctaaggcggtcagagatatatcgttttctaatgatgggactaagttcttgagtgctgggtatgacaggaatatacagtattgggatactgagaccgggcaggtgatctcgaccttctctactggcaaggtcccttatgtagtgaagctcaacccggatgaggataagcagcatgttctcctcgctgggatgagtgacaagaagattgtgcagtgggatatgaagtcagggcagataacccaagagtacgaccagcacttgggagcagtcaataccatcacttttgtagataataataggaggtttgtgacatcaagcgatgacaagtcgcttcgtgtgtgggagttcggcatcccagtggtgattaagtatatcagtgaaccacacatgcattcaatgccatcaatatcactgcacccgaattccaactggctggcagcacagagcttggacaatcagatattgatatacagtaccaaggagaggtttcaacttaacaagaagaagcggtttgcgggtcacattgtggcaggttacgcttgtcaagtgaacttctcaccagatgggaggttcgtgatgtcaggagatggtgaaggtagttgctggttctgggactggaaaagctgcaggagatttaagacgttgaagtgccacaatggagtttgcattggatgtgagtggcatcccttggagactagcaaggttgcaacatgtggatgggatggcgtaattaagtactgggat

SEQ ID NO: 4717 - DNA, 369 bp, Oryza sativa
atggcccggatcaaggtgcacgagctccgggggaagaacaaggcggagctgcaggcccagctcaaggacctcaaggcggagctctccctcctccgcgtcgccaaggtcaccggcggcgcccccaacaagctctccaagatcaaggtggtgcgcacctcgatcgcgcgcgtgctgacggtgatctcgcagaagcagaaggcggcgctgagggaggcgtacaagaagaagagcctgctcccgctcgacctccgccccaagaagacccgcgccatccgcaggcgcctcaccaagcaccagctctctttgaagaccgagagggagaagaagcgtgagaagtatttccccatgaggaagtatgctgttaaagct

SEQ ID NO: 4718 - DNA, 420 bp, Oryza sativa
atgtcgaagcgagggaggggagggtcggcggggaacaagttccggatgtcgctgggtctgcctgtggcggcgacggtgaactgcgcggacaacaccggggccaagaacctctacatcatctccgtgaagggcatcaagggccgcctcaaccgcctcccgtccgcctgcgtcggcgacatggtcatggccaccgtcaagaagggcaagcccgatctccgtaagaaggtcatgcccgccgtcatcgtccgccagcgcaagccgtggcgccgcaaggacggtgtctacatgtacttcgaagataatgctggagtgattgtgaatcctaagggtgagatgaaaggttctgctatcactggacccatcgggaaggagtgtgctgacctttggcctaggatagctagtgcagcaaatgctattgtc

SEQ ID NO: 4719 - DNA, 570 bp, Oryza sativa
atggccggggtggcggcgttgcagggcgcgatggcgtccctctccatctctgcgccgggggcggcgagcaccagcagcttctggggccacccgctctccaccttcgccgccgcgccggctggggttaaatttatgatcaagacatgcccaattcaaatgaggcttaagcgatgggagaggaagaagtgtaaaccaaacagtcttcctgtcctccacaagatgcatgttaggattggcgatacagtacaagtcattgcaggccgtgagaaaggtaaagttggagaagttacgcggctttttaagcacaacagcactgtaatagtgaaggacttgaacttgaagtccaagcacaagaaaggaacagaagatgaaccgggtgaaatcgtcatgattgaaggccccattcacagctcaaatgtgatgctctactcaaaggaaaagaatgtggcgagtagggttggacacaaattccttgaggatggaacgaaggttcggtacctggtcaagactggtgaaataattgacagtgctgagaattgggtcaaggtgttcaaggaaggaagttcggag

SEQ ID NO: 4720 - DNA, 720 bp, Oryza sativa
atggcgagcccgcagtgctgcgcgaacccaccgacgctgaacccggccggcggggaggggaaggtggtggagagcttcggcgggatcaaggcgtacgtcgccggcgccgcggagtccaaggccgccgtcgtcctcatctccgatgtcttcgggtttgaagcgccgaacctgaggaagatagccgacaaagttgcctcgtctggatactttgttgtggtgccagatttcttacatggggatcctttagtacctgaaagtactgagaaaccgtttcaaatgtggataaaagaacatggcccggacaaagcatttgaagaggcgaaaccaattattgccgctctgaaggagaaaggagtgtctagtattggggctgtaggttattgctggggtgcaaaggtggtggtagagttagtgaaagctcatgagatccaggctgctgtgatgtgtcacccctcttttgtgactgttgatgatatgaaagaggtcaaatgcccaattgctatacttggagctgaaattgatcgtatgtccccaccagaagtggtgaagcagttcgagcaggttctttcttcaaagtcagggattggccactttgtcaagatcttccctggggttgaacatggatggactgtgagatacaagaatgatgatgcagctgctgtcaagagcgccgaggaagccctggcggacatgattgactggtttaataagaacctgaag

SEQ ID NO: 4721 - DNA, 315 bp, Oryza sativa
atggtgaacgttcccaagaccaagaagacctactgcaagaacaaggagtgcaggaagcacacccttcacaaggtcactcagtacaagaagggtaaggacagcctgtctgcccagggaaagcgccgttatgaccgtaagcagtcaggatatggtggtcagaccaagcctgttttccacaagaaggcaaaaaccaccaagaagattgtgctgaagctgcaatgccaaagctgcaagcattactcccagcaccccatcaagaggtgcaagcatttcgagattggtggagacaagaagggcaagggaacatctcttttc

SEQ ID NO: 4722 - DNA, 420 bp, Oryza sativa; identical to SEQ ID NO: 4718

SEQ ID NO: 4723 - DNA, 459 bp, Oryza sativa
atggcgcccaaggcggagaagaagccggccgcgaagaagcccgcggaggaggagcccgcggcggagaaggccgagaaggccccggcggggaagaagcccaaggcggagaagcgtctccccgccggcaagggcgagaagggcagcggcgaggggaagaaggcggggcggaagaaggggaagaagagcgtcgagacctacaagatctacatcttcaaggtgctcaagcaggtccaccccgacatcggcatctcctccaaggccatgtccatcatgaactccttcatcaacgacatcttcgagaagctcgccgccgaggccgccaagctcgcccgctacaacaagaagcccaccatcacctcccgggagatccagaccgccgtccgcctcgtcctccccggcgagcttgccaagcacgccgtctccgagggcaccaaggccgtcaccaagttcacttcctct

SEQ ID NO: 4724 - DNA, 1947 bp, Oryza sativa
atggcgggcaagggcgagggtccggccatcggcatcgaccttggcacgacctactcgtgcgtgggcgtttggcagcacgaccgcgtggagatcatcgccaacgaccagggcaaccgcaccaccccctcctacgtcggcttcaccgactccgagaggctcatcggagatgctgccaagaaccaggtcgccatgaaccccatcaacaccgtctttgatgccaagcgtctcattggcaggaggtttagcgatgcttctgttcagagtgacattaagctctggcccttcaaggtgattgctggacctggtgacaagcctatgattgttgtccagtacaagggtgaggagaagcagtttgctgcagaagagatctcctccatggtcctcatcaagatgcgtgagattgctgaggcctaccttggcaccaccatcaagaatgccgttgtcactgttcctgcctacttcaatgactcccagaggcaggccaccaaggatgctggagtgattgctggtctcaatgtcatgcgtatcatcaacgagccgactgctgcagctattgcctatggtcttgataagaaggccaccagcgttggtgagaagaatgtcctcatctttgaccttggaggtggtacctttgatgtctccctccttaccattgaggagggtatctttgaggtcaaggccacagctggtgacacccatcttggtggtgaagattttgacaatcgtatggtcaaccactttgtgcaagaattcaagaggaagaacaagaaggatatcactggcaaccccagggctctcaggaggttgaggacagcttgtgagagggcaaagaggaccctgtcctccactgcccagaccaccattgagatcgattccctgtatgagggcatcgacttctactcaaccatcacccgtgccaggtttgaggagctcaacatggatctcttcaggaagtgtatggagcctgtggagaagtgcctcagggatgctaagatggacaagagctctgttcatgatgttgtccttgttggtggctccactaggatcccgagggtgcagcagctcctgcaggatttcttcaacggcaaggagctttgcaagaacatcaacccagatgaggctgttgcttatggtgctgctgtccaggctgccatcttgagtggtgagggcaacgagaaggtccaggacctcctcctgttggatgttacccctctctctctcggtttggagactgctggtggtgtcatgaccgttttgatcccaaggaacaccaccattcccaccaagaaggagcaggtcttctccacctactccgacaaccagcctggtgtgctcatccaggtttatgagggtgagaggaccaggacacgtgacaacaacctgctggggaagtttgagctctctggaatccctcctgctcccaggggtgttccacagatcactgtttgcttcgacattgatgccaatggtatcctgaacgtgtctgctgaggacaagaccaccgggcagaagaacaagatcaccattaccaacgacaagggcaggcttagcaaggaggagattgagaagatggtccaggaggccgagaagttcttttcagaggatgaggagcacaagaagaaggtggagtccaagaacgcgctggagaactacgcctacaacatgcgcaacaccatcaaggatgagaagatcgcctcgaagctcccggcagcggacaagaagaagatcgaggatgccatcgaccaggccatccagtggctggacggcaaccagctcgctgaggctgatgagttcgatgacaagatgaaggagctggagggcatctgcaaccccatcatcgccaagatgtaccagggcgctggcgcggacatggccggcggcatggacgaggacgatgctcccccggctggcggcagcggtgctggccccaagatcgaggaggtcgac

SEQ ID NO: 4725 - DNA, 318 bp, Oryza sativa
atggtgaacgttcccaagaccaagaagacctactgcaagaacaaggggagtgcaggaagcacactccttcacaaggtcactcagtacaagaagggtaaggacagcctgtctgcccagggaaagcgccgttatgaccgtaagcagtcaggatatggtggtcagaccaagcctgttttccacaagaaggcaaaaaccaccaagaagattgtgctgaagctgcaatgccaaagctgcaagcattactcccagcaccccatcaagaggtgcaagcatttcgagattggtggagacaagaagggcaagggaacatctcttttc

SEQ ID NO: 4726 - DNA, 315 bp, Oryza sativa; identical to SEQ ID NO: 4721

SEQ ID NO: 4727 - DNA, 399 bp, Oryza sativa
atggcgtccaaggcgttcgctctgttcctggccgtgaacctcgtcgtgctcggggtggcaagcgcctgcggcggcagcccgtcgtgcccgacgccgacgccgtcgaccccgacaccgtcaacgccgacgccgacgccgtcggcgttcgggaggtgcccccgcgacgcgctgaagctgggcgtgtgcgccaacgtgctgggcctgatcaaggccaaggtgggcgtgcctccggcggagccgtgctgcccgctgctggaggggctcgtcgacctcgaggcggcggtgtgcctctgcacggccatcaggggcaacatcctcggaatcaacctcaacctccccatcgacctcagcctcatcctcaactactgcggcaagaccgtccccaccggcttcaagtgc

SEQ ID NO: 4728 - DNA, 525 bp, Oryza sativa
atggcccccaccgtgatggcctcctcggccacctccgtggctccattccaagggctcaagtccaccgccgggctccccgtcagccgccgctccaccaactcgggcttcggcaacgtcagcaatggcggaaggatcaagtgcatgcaggtgtggccaattgagggcatcaagaagttcgagaccctatcgtacctgccaccactcaccgtggaggatcttttgaagcagatcgagtacctgcttcgatccaagtgggtgccttgcctcgagttcagcaaggttggattcgtctaccgtgagaaccacaggtctcccgggtactacgatggcaggtattggaccatgtggaagctgcccatgttcggctgcaccgatgccacccaggtgctcaaggagctcgaggaggccaagaaggcctaccccgatgcctttgtccgtatcatcggcttcgacaacgtcaggcaggtgcagttgattagcttcatcgcctacaagcccccaggttgcgaggagtctggtggcaac

SEQ ID NO: 4729 - DNA, 912 bp, Oryza sativa
atgggagggtttgtcaagacccagaagaccaatgcctaccacaagcgtttccaagtcaagttcaagagacggaggcagggcaagactgactacagggccaggattaggctcaccaaccaagataagaacaagtacaacacaccgaagtaccgcttcgttgtgagatttacaaacaaagatatcacagctcaaattgtctatgctaccattgctggtgatatcgtgatggctgctgcctactcccatgagctgcctcgctatggtcttgaagttggtctcaccaactatgcggcagcttattgcactggcttgcttttggctcgccgtgtgctcaagctccgtggtttggaccaggagtacgagggcaatattgaggccactggggaggactactatgttgaaccagctgatgaaaggcggcctttccgtgctctcttggatgttggcctcattaggacaaccactggaaaccgtgtctttggtgccctcaagggagctttggatggtggtcttgacattcctcacagtgacaagaggtttgctgggttcaagaaggacgagaagcagcttgattctgatattcaccgcaagtacatctacggtgggcacgtggctgactacatgaggtctatggcggaggaggaacctgagaaattccaagcccacttcagtgagtacctcaagaagggaattgatgctgatggcatggaagcactgtacaagaaggtccatgctgccatccgtgctgatcctaccatggccaaatcaaccaagaaggaaccggcgacccacaagagatacaacctcaagaagctaacctacgaacagaggaaggccagtcttgtcgaaagattgaatgctctcaactcctctgctggtgctgatgatgatgacgaggaagaggatgatgag

SEQ ID NO: 4730 - DNA, 309 bp, Oryza sativa
atgtcgggccgtggcaagggaggcaaggggctgggcaagggaggcgcgaagaggcacaggaaggtgctgcgcgacaacatccaggggatcacgaagcccgcgatccggaggctggcgaggaggggcggcgtgaagcgcatctccgggctgatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggc

SEQ ID NO: 4731 - DNA, 672 bp, Oryza sativa
atgagcaaggagaagcaccacaagcgggagcaccacctccggcgatgctgcggcgggatggcggcgtgcatcctggcgctggtcctcgtcgtcggcttcatcgcgctcgtcgtctacctcgcgctccgcccctccaagccgtccttctacctgcaggacctccagctccgctccgtcgacctcggcgacccctccctctccgccaccgcgcaggtcaccctcgcctcccgcaaccccaatgaccacgtcggcgtccactaccgccgcctcgacgtcttcgtcacctaccgcgacgaacccgtcacggtgcccgtctccctcccgccgacctaccagggccaccgcgacgtcaccatctggtcgcccgtgctctccggcgagtccgtccccgtggcgggcttcgtcgccgacgcgctcaggcaggacgtcgccgccgggtacgtcgcgctgcaggtgaaggtcgacggccgcgtcaagtggaaggtcggcagctgggtctccggcagctaccacctctttgtcagctgccccgccatgctcgcctccgccggaccaggcggcgtcggccccatgcctctcggcggcgcctccgccgccgtcgtgaacggcaccggcgccggcgccgtcgcgtcgctcaggttcacgcagccgacagggtgcagcgtcgaggtg

SEQ ID NO: 4732 - DNA, 309 bp, Oryza sativa
atgtcggggcgcggcaagggcggcaaggggctcggcaagggcggcgcgaagaggcatcgcaaggtgctccgcgacaacatccagggcatcaccaagccggcgatccggaggctggcgaggaggggcggcgtgaagcgcatctccgggctgatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggcggc

SEQ ID NO: 4733 - DNA, 309 bp, Oryza sativa; identical to SEQ ID NO: 4732

SEQ ID NO: 4734 - DNA, 309 bp, Oryza sativa
atgtcggggcgcggcaagggaggcaaggggctgggcaagggcggcgcgaagcgccaccgcaaggtgctccgcgacaacatccaggggatcaccaagccggcgatccggaggctggcgaggaggggcggcgtcaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggaggc

SEQ ID NO: 4735 - DNA, 699 bp, Oryza sativa
atgtcgacggaggcggagaccaccagcgccgccgcccccgcccccgcccccgcccccgcatcggcgccggcgcggtgccagcggataggctgcgacgccacgttcaccgacgacaacaaccccgacggctcctgccaataccacccctccggacctatgtttcatgatggcatgaaacagtggagttgctgtaagcaaaaaagccatgattttagcctatttttggctattcctgggtgcaaaactggaaagcacacaactgagaaaccaatcacaaaagcagttcctactaaaccatcaaaggcagttccagtccagacttcgaagcagagtgtgggagctgacacttgctcaaggtgccgtcaaggtttcttttgctctgaccatggatcacaacccaaggcacaaataccaaccgctaccagtgatactaacatggtacctgttgagaagcctgcagttccaccaccaaagaaaaaaattgatctgaatgagcctagggtttgtaagaacaaaggatgtggtaaaacctacaaggagaaggataatcatgatgaagcatgcgattaccatccaggacctgcagtttttcgcgacaggattagagggtggaaatgttgtgatattcatgtcaaggaatttgatgaatttatggagatccctccgtgcacaaagggttggcacaatgctgatgccgca

SEQ ID NO: 4736 - DNA, 1320 bp, Oryza sativa
atgggggagtgcaaggtgggaggaggaggcggaggcggagactgcttgatcaagctgttcgggaagaccatccccgtgccagagcccggcgcctgcgccgccggcgatgttgataaggaccttcaacacagtggcagcagcacgactgaaccgaaaactcaagagaacaccgttcaagactccacaagtccacctccgcagccagaggtcgtcgacaccgaggactcttcagctgataagaactcatcagagaatcagcagcagcagggcgatacggccaaccagaaggagaagctgaagaagcctgacaagatcctgccgtgcccccggtgtagcagcatggacaccaagttctgctactacaacaactacaacatcaaccagccgcgccacttctgcaagaactgccagaggtactggacagcgggtggtgccatgcgcaacgtgcctgtgggtgcaggccgacgcaagagcaagagcgtatcggccgcttcccatttcctccagagggtcagggctgctctgcccggtgatcctcctctctatgccccagtgaagactaatggcaccgttctcagcttcggctccgacctgtccaccttagacctcacagaacaaatgaagcatctaaaagataagtttatcccaacaaccggtatcaagaacaccgacgagatgccagtcggtttgtgtgctgaaggattgtcgaaaacagaagaatcgaaccaaacgaacctaaaggagaaagtttcagcagatagatctccaaatgttgcacaacacccatgcatgaacggaggagccatgtggccatttggcgtggcaccaccacctgcttattacacttcaagcattgcaattccattctatccagctgcagcagctgctgttgctgcatactggggctgcatggttccaggagcttggaacgctccatggccaccgcagtcccaatcccaatcggtttcatcatcaagtgctgcttctccagtatccacaatgaccaactgcttcagattaggaaagcaccctagagatggtgatgaggaactggatagcaagggtaatggcaaggtgtgggtgccgaagacggttcggatcgacgatgtcgacgaggtggccaggagctctatctggtcgcttattgggatcaagggtgacaaggtgggagcagatcatggcagaggatgcaagcttgcaaaggtttttgagtcaaaggatgaggcaaaggcatcaactcacacagcgatcagcagcttgccattcatgcaggggaacccggctgccctaacacgctcggtgaccttccaagagggatct

SEQ ID NO: 4737 - DNA, 525 bp, Oryza sativa; identical to SEQ ID NO: 4728

SEQ ID NO: 4738 - DNA, 1014 bp, Oryza sativa
atgggctgctccatctcggggctcaacgccctctacgacgcggcgacgggcggcggcgacgtgtggatcaacgagcgccgcttccgcgtcctgcgccagattggggagggcggcttcgccttcgtctacctcgtcagggagcaccaggcctccgccgacgccgcccgcggccggagcccctccctcgcctcagaggatgggacatatgctatgaagaaggtgctgatacagagcaaggaacagctagatctggtgaaggaggagatccgtgtttcgtcattgttcaaccatcctaacctgcttccgcttcttgatcatgccgtgatagcagttaagaatcaacagggagattggaaccatgaagcctacttgctcttccctgtctatatcgatggtactctgtttgacaatgccaaagtcatgcaatccaggaaggaattctattcaacaatcgatgttttgagaatattccaacagctctgtgaaggactgaagcacatgcacagttttgatccaccatatgcccataatgacgttaagactggcaatgttcttataactcacagaaaaggacaagcacctcttgcaactttaatggattttggaagtgcaaggcctgcaagaaaagaaatccgttctcgtgctgaagcattacgattgcaggaatgggccgctgaacattgctctgcgccttaccgtgcacctgaactgtgggactgcccaagtcatgccgatatcgatgagagtgacagacatttggttctcttagtatgcaccctttatgctatcatgtacaatgtttcgccatttgagtatgctctcggtgaatctggagaaagcttgcaattagccattgtcaactgcacgctgaagtggccggcaggacccagccctccttaccctgatgcacttcatcagtttattacctggatgcttcagccacaacctgcaatgcgccctcacatcgatgacataattctacatgtcgaaaagcttatggaaaaatattcgtct

SEQ ID NO: 4739 - DNA, 525 bp, Oryza sativa; identical to SEQ ID NO: 4728

SEQ ID NO: 4740 - DNA, 696 bp, Oryza sativa
atggccggccgtgcgacggcgacggcgacggcggcggggaaggacaggtccagcttcgccgtcacctgtagcctcctcagccagtttctcaaggagaagaagggcggcggcggcgggctgcaggggctcggactcggcttgcggccggcgccggcggcgccgaccgccgtgggagctggaggtgctttccggccgtcgccgaccaccatgaacttgctgacggggctcgacgcgccggcggtggaggtggagccaaacacggcggaaacagcggccgacgagctgcctctcatcaaggccccggccgatcagcaaagcgacgaaagtgcaagtgaggcagctggagagaaggctcaacagctgaccatcttctacggtggaaaagtagtcgtctttgagaacttcccgtccaccaaggtcaaggatctcttacaaatcgtaagcacaggcgatggcgtcgacaagaacaccggcaccgcggcaacgcagagcctgccccgacccgcacacaacagtcttcccgatctgccgattgcaaggaggaactcgctccataggtttctcgagaagagaaagggcaggatgaatgcaaatgctccataccaagctaactgcaccgctgcaccgtccaagcaagctaacggtgacaaatcttggcttgggtttggccaagagatgacaataaagcaggagata

SEQ ID NO: 4741 - DNA, 1329 bp, Oryza sativa
atgagggagtgcatctcgatccacatcgggcaggccggtatccaggtcgggaacgcgtgctgggagctctattgcctcgagcatggcatccagcctgatggacagatgcccggtgacaagaccgttgggggaggtgatgatgcttttaacaccttcttcagtgagactggtgctgggaagcatgtcccccgtgctgtcttcgtcgatcttgagcctaccgtgattgatgaggtgaggactggtgactaccgccagctcttccaccctgagcagctcatcagtggcaaggaggatgcagccaacaactttgcccgtggtcactacaccattggcaaggagattgttgatctgtgccttgaccgcatcaggaagcttgccgacaactgcactggtctccagggcttccttgtgttcaacgctgttggaggaggaacgggctccggtctcggttcccttctccttgagcgtctctctgtggactatggcaagaagtccaagctcgggttcaccgtgtacccgtcccctcaggtctccacctctgtaggtgtgagccatacaacagtgtcctctccacccactcccttcttgagcacaccgatgtccgctgtactgctcgacaatgaggccatctatgacatctgccgccgctccctctacattgagcgcccaacctacaccaacctcaacaggcttgtgtcccaggacatctactcactgactgcctccctgaggttcgatggtgctctgatggtggatgtcaacgagttccaaaccaacctggagccctaccccgaggatccacttcatgctttcctcctacgccccggtgatctcgggcgagtatgcctaccacgagcagctctccgtggcggagatcaccaacagcgccttcgagccgtcctccatgatggccaagtgcgacccgcgccacggcaagtacatggcgtgctgcctgatgtaccgcggcgacgtggtccccaaggacgtgaacgccgcggtggccaccatcaagacgaagcgcaccatccagttcgtggactggtgccccacggggttcaagtgcggcatcaactaccagccgcccagcgtcgtcccggggggagacctggccaaggtgcagagggccgtgtgcatgatctccaactccaccagcgtcgtcgaggtgttctcccgcatcgacatcaagttcgacctcatgtactccaagcgcgccttcgtccactggtacgtcggcgagggcatggaggagggggagttctccgaggcccgcgaggacctcgccgcgctggagaaggactacgaggaggtcggctccgagttcgacgatgg

SEQ ID NO: 4742 - DNA, 465 bp, Oryza sativa
atgcagatcttcgtgaagaccctgacggggaagacgatcacgctggaggtggagtcctcggacaccatcgacaacgtgaaggcgaagatccaggacaaggaggggatcccgcccgaccagcagcggctcatcttcgccggcaagcagctggaggacgggcgcaccctcgccgactacaacatccagaaggagtcgaccctccacctggtgctccgcctccgcggcggcgccaagaagcgcaagaagaagacgtacaccaagcccaagaagcagaagcacaagcacaagaaggtgaagctcgccgtgctccagttctacaaggtggacgacgccaccggcaaggtcacccgcctccgcaaggagtgccccaacgccgagtgcggcgccggcaccttcatggccaaccacttcgaccgccactactgcggtaagtgcggcctcacctacgtctacaaccagcaggct

SEQ ID NO: 4743 - DNA, 591 bp, Oryza sativa
  misc_feature (4)..(5): n = any nucleotide
  misc_feature (72)..(74): n = any nucleotide
atgnnaggtggcaaggacaagcatgacgagagcgacaagggcttcttctctaacatgatgcacggcgtgcgnnncggccatgggtatcctcctcaccagggataccctctccagggctacccgccgccgccgggagcgtacccgcctcctccgggggcttatccccctcctcctggggcttaccctccaccacctggggcataccctccacagcatgggtaccctcagcctggtggctaccctccacctggtggttacccccaacatggtggctaccctcctgcgggctaccccggatcatctgggcaccagggcggccatgggagtagcggtggaggacacatgggagcaatgctggctggaggcgccgctgcggctgctgcagcctatggggcacacaagatctcttctcatggccatggtggacacatgggctatggaggccatggaggctttggtggttacggccatggctacggcggtcaccacggcggcaagttcaagcatggcaagcacggccaccatggcaagttcaagcatggcaagcatgggcacggcatgttcggtggtggcaagttcaagaagtggaag

SEQ ID NO: 4744 - DNA, 591 bp, Oryza sativa
atgggaggtggcaaggacaagcatgacgagagcgacaaggggctcttctctaacatgatgcacggcgttgccggcggccatgggtatcctcctcaccagggataccctcctcagggctacccgccgccgccgggagcgtacccgcctcctccgggggcttatccccctcctcctggggcttaccctccaccacctggggcataccctccacagcatgggtaccctcagcctggtggctaccctccacctggtggttacccccaacatggtggctaccctcctgcgggctaccccggatcatctgggcaccagggcggccatgggagtagcggtggaggacacatgggagcaatgctggctggaggcgccgctgcggctgctgcagcctatggggcacacaagatctcttctcatggccatggtggacacatgggctatggaggccatggaggctttggtggttacggccatggctacggcggtcaccacggcggcaagttcaagcatggcaagcacggccaccatggcaagttcaagcatggcaagcatgggcacggcatgttcggtggtggcaagttcaagaagtggaag

SEQ ID NO: 4745 - DNA, 1287 bp, Oryza sativa
atggcgggcgcggtgtcggcgctgttccttctggacatcaagggccgcgtcctcgtctggcgcgactaccgcggcgacgtctccgccctccaggctgagcgcttcttcaccaagctcctcgacaaggagggcgactcggaggcgcactcgccggtggtctacgacgatgccggggtcacctacatgttcatccagcacaacaacgtgttcctactaaccgcctcccgccagaactgcaacgccgccagcatcctcctcttcctccaccgcgtcgttgatgtgttcaagcactatttcgaagagttggaggaagagtcgctgagggataactttgtcgttgtgtatgagttgcttgatgaaatgatggattttgggtacccacaatacacggaggcgaaaatcttaagtgaattcattaagacggatgcgtacaggatggaggtatcacagaggccacctatggcagtgacaaatgccgtgtcatggcggagtgagggtattcggtacaagaagaatgaagtgttcttggatgttgtggagagtgttaacattcttgttaacagcaatgggcagattgtgagatcagatgttgttggggcactgaagatgcggacatatttgagtggaatgcctgagtgcaaacttggattgaacgatagggttcttttggaggctcaaggccgagctactaaaggaaaagcaatagatcttgatgatattaaatttcaccagtgcgtgaggttggctagatttgagaatgatagaactatatccttcatacctcctgacggatctttcgatctaatgacatacagacttagcacccaggtaaaaccacttatctgggtggaagcacaaattgagaaacattcaagaagccgaatagaacttatggtgaaagcaagaagtcagtttaaggaaaggagcacagcaacaaatgttgaaattgaagtgcctgttccttcagatgctacgaaccctaatataagaacttcaatgggctctgctgcatatgcacctgagagagatgcaatggtctggaaagtaaaatcatttcctggtggcaaggattacatgtgcagagctgaatttagtcttccaagtataactgcagaagaagcagctcctgaaaagaaggcaccaatacgagtgaaatttgagataccatatttcactgtgtcgggtattcaggttcgctatctgaagatcattgaaaagagtgggtaccaggcgcttccttgggttagatacattacaatggctggtgaatacgaactgagacttata

SEQ ID NO: 4746 - DNA, 510 bp, Oryza sativa
atggcctcctcggccacctccgtggctccattccaagggctcaagtccaccgccgggctccccgtcagccgccgctccaccaactcgggcttcggcaacgtcagcaatggcggaaggatcaagtgcatgcaggtgtggccaattgagggcatcaagaagttcgagaccctatcgtacctgccaccactcaccgtggaggatcttttgaagcagatcgagtacctgcttcgatccaagtgggtgccttgcctcgagttcagcaaggttggattcgtctaccgtgagaaccacaggtctcccgggtactacgatggcaggtattggaccatgtggaagctgcccatgttcggctgcaccgatgccacccaggtgctcaaggagctcgaggaggccaagaaggcctaccccgatgcctttgtccgtatcatcggcttcgacaacgtcaggcaggtgcagttgattagcttcatcgcctacaagcccccaggttgcgaggagtctggtggcaac

SEQ ID NO: 4747 - DNA, 525 bp, Oryza sativa; identical to SEQ ID NO: 4728

SEQ ID NO: 4748 - DNA, 750 bp, Oryza sativa
atgccgatccgcaacatcgccgtggggagccaccaggaggtgtaccacccgggtgcactcaaggcggcgttggccgagttcatctccaccctcatcttcgtcttcgccggccagggctccggcatggccttcagcaagctgaccggcggcggagcgacgacccccgccgggctgatcgcggcggcggtggcccacgccttcgccctgttcgtggcggtgtccgtcggcgccaacatctccggcggccacgtgaacccggccgtgaccttcggcgccttcgtcggcggcaacatcaccctgttccgcggcctcctctactggatcgcccagctcctgggctccaccgtggcgtgcttcctcctccgcttctccaccggcgggctcgccaccggcaccttcggcctgaccggcgtctccgtgtgggaggccctggtgctggagatcgtcatgaccttcggcctcgtctacaccgtgtacgccaccgccgttgaccccaagaagggcagcctcggcaccatcgcccccatcgccatcggcttcatcgtcggcgcgaacatcctcgtcggcggcgcgttcgacggcgcctccatgaacccggccgtctccttcggcccggccctcgtcagctggtcctgggagtcccagtgggtgtactgggttggcccactcatcggcggtggcctcgccggcgtcatctacgaggtcctcttcatctcccacacccacgagcagctccccaccaccgactac

SEQ ID NO: 4749 - DNA, 750 bp, Oryza sativa; identical to SEQ ID NO: 4748

SEQ ID NO: 4750 - DNA, 525 bp, Oryza sativa; identical to SEQ ID NO: 4728

SEQ ID NO: 4751 - DNA, 525 bp, Oryza sativa; identical to SEQ ID NO: 4728

SEQ ID NO: 4752 - DNA, 1311 bp, Oryza sativa
atgggcaagcaccatgtcaccctgtgttgtgtcgtttttgctgtgctctgcctggcgtccagcttagcacaagcccaagttctcttccaggggtttaactgggagtcgtggaggaagcaaggcgggtggtacaactttctgcacgagaaggtggaggagatcgccagcacgggcgccacccacgtctggctcccgccgccgtcgcactctgtctcgccgcagggttacatgccggggcggctctacgacctggacgcgtccaagtacggcacggaggcggagctcaagtcgctgatcgaggcattccacgacaagaacgtcgagtgcctcgccgacatcgtcatcaaccaccgctgcgccgactacaaggacagccgcggcgtgtactgcgtgttcgagggcggcacgcccgacggccgcctcgactggggccccgacatgatctgcagcgacgacacgcagtactccaacggccgcggccaccgcgacaccggcgccgggttcggcgccgcgcccgacatcgaccacctcaacccgcgtgtccagcgggagctcaccgactggctcaactggctcaggaccgacctcggcttcgacggctggcgcctcgacttcgccaagggctactccgcgccgctggcgaggatctacgtcgacaacaccaacccgacgttcgtcgtcggcgagatctggagctcgctcatctacaacggcgacggcaagccgtcgaccaaccaggacgcggacaggcaggagctggtgaactgggtggagggcgtcggcaagccggcgacggcgttcgacttcaccaccaagggcatcctccaggccgccgtgcagggcgagctgtggaggctccacgacggcaacggcaaggcgcccggcctcatggggtggatgcccgatcaggccgtaaccttcgtcgacaaccacgacaccggctcgacccagtcgctctggccgttcccttccgacaaggtcatgcagggctacgcctacatcctcactcaccctggcatcccatgcatcttctacgaccatgtgttcgactggaacctgcagcacgagatcgcgacgctggctgaaatccggtcaaggaacgggatccatgcggagagcacgctggacatcctcaaggccgagggggacatctacgtcgccatgatcgacggcaaggtgatcaccaagctcgggccgaggtacgacgccggcgggatcatcccctccgacttccatgtcgtggcgcacggcaacgactactgcgtctgggagaaggaaggcctcagggttcctgccggtagaaagcactat

SEQ ID NO: 4753 - DNA, 1353 bp, Oryza sativa
atgagggagtgcatctcgatccacatcgggcaggccggtatccaggtcgggaacgcgtgctgggagctctattgcctcgagcatggcatccagcctgatggacagatgcccggtgacaagaccgttgggggaggtgatgatgcttttaacaccttcttcagtgagactggtgctgggaagcatgtcccccgtgctgtcttcgtcgatcttgagcctaccgtgattgatgaggtgaggactggtgactaccgccagctcttccaccctgagcagctcatcagtggcaaggaggatgcagccaacaactttgcccgtggtcactacaccattggcaaggagattgttgatctgtgccttgaccgcatcaggaagcttgccgacaactgcactggtctccagggcttccttgtgttcaacgctgttggaggaggaacgggctccggtctcggttcccttctccttgagcgtctctctgtggactatggcaagaagtccaagctcgggttcaccgtgtacccgtcccctcaggtctccacctctgtggttgagccatacaacagtgtcctctccacccactccctccttgagcacaccgatgtcgctgtcctgctcgacaatgaggccatctatgacatctgccgccgctccctcgacattgagcgcccaacctacaccaacctcaacaggcttgtgtcccaggtcatctcctcactgactgcctccctgaggttcgatggtgctctgaatgtggatgtcaacgagttccaaaccaacctggtgccctacccgaggatccacttcatgctttcctcctacgccccggtgatctcggccgagaaggcctaccacgagcagctctccgtggcggagatcaccaacagcgccttcgagccgtcctccatgatggccaagtgcgacccgcgccacggcaagtacatggcgtgctgcctgatgtaccgcggcgacgtggtccccaaggacgtgaacgccgcggtggccaccatcaagacgaagcgcaccatccagttcgtggactggtgccccacggggttcaagtgcggcatcaactaccagccgcccagcgtcgtcccggggggagacctggccaaggtgcagagggccgtgtgcatgatctccaactccaccagcgtcgtcgaggtgttctcccgcatcgacatcaagttcgacctcatgtactccaagcgcgccttcgtccactggtacgtcggcgagggcatggaggagggggagttctccgaggcccgcgaggacctcgccgcgctggagaaggactacgaggaggtcggctccgagttcgacgatggtgacgagggtgatgagggtgacgagtac

SEQ ID NO: 4754 - DNA, 465 bp, Oryza sativa
atggcgcccaaggcggagaagaagccggccgcgaagaagcccgcggaggaggagcccgcggcggagaaggccgagaaggccccggccgggaagaagcccaaggcggagaagcggctccccgccggcaagggcgagaagggctccggcgaggggaagaaggaccgcgctgggaggaagaaggcgaagaagagcgtcgagacctacaagatctacatcttcaaggtgctcaagcaggtccaccccgacatcggcatctcctccaaggccatgtccatcatgaactccttcatcaacgacatcttcgagaagctcgccgccgaggccgccaagctcgcccgctacaacaagaagcccaccatcacctcccgcgagatccagacctccgtccgcctcgtcctccccggcgagcttgccaagcacgccgtctccgagggcaccaaggctgtgaccaagttcacctccgct

SEQ ID NO: 4755 - DNA, 564 bp, Oryza sativa
atggacaagaagcagtgcggcgccaagggcggaggcggcggcaatgctcgccggagcgcgacgggcggcggcgcggggaggatgcatcggaaggggaagcatcagggcgacggcggaggcggaggagggaagaggagggagatcaaggtggtgtacatcgccaacccgatgcgggtgaccaccagcgaggagggcttccgcgcgctcgtgcaggagctcaccggccggcacgccgacccgtccaagtaccgcggcggcggcggcggcgcgcccgtcgacgagaccagcggcggtggtggcggcggcggcggcgagatgatgcagggcgcggcggcgatgatgcagcccagcccgggcagcaccgtggactcgtcgtcgacggaccacggcggcgccggcgccggcgggcagggcgccggcctgcaggcggcggcgctggacgacgacgagaacagcttcatcgcgccggagctgatcgacaacaggtactccgtctgcttctcgccgccgacgttcctctacggcggcggctcgcacacctacgacggcgacgactacggtttg

SEQ ID NO: 4756 - DNA, 582 bp, Oryza sativa
atgggaggtggcaaggacaagcatgacgagagcgacaaggggctcttctctaacatgatgcacggcgttgccggcggccatgggtatcctcctcaccagggataccctcctcagggctacccgccgccgccgggagcgtacccgcctcctccgggggcttatccccctcctcctggggcttaccctccaccacctggggcataccctccacagcatgggtaccctcagcctggtggctaccctccacctggtggttacccccaacatggtggctaccctcctgcgggctaccccggatcatctgggcaccagggcggccatgggagtatcggtggaggacacatgggagcaatgctggctggaggcgccgctgcggctgctgcagcctatggggcacacaagatctcttctcatggccatggtggacacatgggctatggaggccatggaggctttggtggttacagccatggctacggcggtcaccacggcggcaagttcaagcatggcaagcacggccaccatggcaagttcaagcatggcaagcatgggcacggcatgttcgggtgttggcaagttcaa

SEQ ID NO: 4757 - DNA, 804 bp, Oryza sativa
atggtcaccgcgctagcccacgtcatccgcgccgcccccgacctgcacctcccccaccacccatcctcctccgcctccgccgccgcccacccgcagcaggcttcttccttctacccgaccgccgccgccgccgcctcctcgccgtccgaccagctcgccgccgccgccgctgccgaagagcaagggaggaggcggcactacagaggtgttcgacagcggccatgggggaagtgggcggcggagataagggacccgaagaaggcggcgagggtgtggctggggacgttcgacacggcggaggacgccgccatcgcctacgacgaggcggcgctccggttcaaggggaccaaggccaagctcaacttccccgagcgcgtccagggccgcaccgacctcggcttcctcgtcacccgtggcatcccccccgccgccacccacggtggcggctactacccctcgtcgtcgccggcggcggcggcatgccccccgccgcggcagcagcagacggtcgtgccgtacccggacctcatgcggtacgcgcagctgctgcagggcggcgtcggcggcagttacatgccgttcggcggcgccgcgacgatgtcgtcgtcgacggtgtcgtcctcgtcggcgccgcagatactcgacttctcgacgcagcagctcatccgggccggcccgccgtcaccaatgccatcgtcgggctccggctcggcgaccgcggcggcgtcgtccacgacgtcggcgtcgtcgcccggtgcatggccgtacggcggctcggagcgcaagaagaaggattcgtcgtcg

SEQ ID NO: 4758 - DNA, 750 bp, Oryza sativa
atgccgatccgcaacatcgccgtggggagccaccaggaggtgtaccacccgggtgcactcaaggcggcgttggccgagttcatctccaccctcatcttcgtcttcgccggccagggctccggcatggccttcagcaagctgaccggcggcggagcgacgacccccgccgggctgatcgcggcggcggtggcccacgccttcgccctgttcgtggcggtgtccgtcggcgccaacatctccggcggccacgtgaacccggccgtgaccttcggcgccttcgtcggcggcaacatcaccctgttccgcggcctcctctactggatcgcccagctcctgggctccaccgtggcgtgcttcctcctccgcttctccaccggcgggctcgccaccggcaccttcggcctgaccggcgtctccgtgtgggaggccctggtgctggagatcgtcatgaccttcggcctcgtctacaccgtgtacgccacccccgttgaccccaaaaagggcagcctgggcaccatcgcccccatcgccatgggtttcatggtcggcgcgaacatcttcgtcggcggcgcgttcgacggcgcctccatgaacccggccgtttctttcggcccggccctcgtcagttggtcttgggagtcccagtgggtgtactgggttggcccactcatcggcggtggcctcgccggggtcatttacgaggtctttttcttttcccacacccacgagcagctccccccccccgattat

SEQ ID NO: 4759 - DNA, 834 bp, Oryza sativa
atgccggttgccggagcggggtggtgggatctcgtgaacggctcgacggcgtggcaggacgggatcttcctctccctcgccgctctctacggcctcgtcgccgcatcctccttcatccaagttgttaggatacagtacagagttcctgaatatggatggacaacacaaaaggtctttcaattacttaatttcattgtgaatggagcgaggtgttctatctttgcagtccgccgccaagtccaacaagtgaaccctgagatctttcagcatgttattcttgatcttccggggcttgcattcttcacaacgtatgcaatgttggcacttttctgggctgagatatcttatcaagcacgtggtctagagactgaagggcttagatcaggtttctacactattaatggtgtaatatatgtgatacaggttctgctgtgggcgttgttgtggcacaatccaaacccatctatgatagtcctttcgaagttgttcattgcaggcctatccttttctgcagccttgggttttctgctatatggagggaggcttttcttcatgctgaagcgttttcctattgagtcaaaagggaggcagaaaaaactgagggaagttgggagagttgccactatatgcttcctttgtttcttggcacgatgcattatgatgtgctttgatgcatttgacaaaaaagctgaccttgatgtgcttgaccatccaattcttaatttcatctattacctgatcgttgaaattcttccttcatctcttgtcctgtttattctgaggagaatcccttataagttacggctcgcccagtatcatcccctcaacagtgtt

SEQ ID NO: 4760 - DNA, 672 bp, Oryza sativa; identical to SEQ ID NO: 4731

SEQ ID NO: 4761 - DNA, 300 bp, Oryza sativa
atgtcggccgccggggaggaggacaagaagccggcggggggagagggcggcggcgcccacatcaacctcaaggtcaagggacaggatgggaacgaggtattcttccgcatcaagagatctacgcagctgaagaagctgatgaacgcctattgtgaccgtcagtctgtggatatgaatgctattgcattcctatttgatggtcgtaggctccgtggcgagcagacccctgacgagctcgagatggaagacggggacgagatcgacgccatgctccaccagactggaggctgcctgcctgcc

SEQ ID NO: 4762 - DNA, 525 bp, Oryza sativa; identical to SEQ ID NO: 4728

SEQ ID NO: 4763 - DNA, 414 bp, Oryza sativa
atggcgggcaagggaggcaaggggctcctcgcggccaagaccacggcggcaaagagcgccgacaaggacaaggacaagaagaaggcccccgtctcccgctcctcccgcgccggcctccagttcccggtggggcgtatccacaggcagctcaagtcgagggcgtcggctcatggccgcgtcggcgccaccgccgccgtgtactccgcggcgattctcgagtacctaaccgccgaggtcctggagctggccggcaacgcgagcaaggatctcaaggtgaagcgtatcaccccgcgccatctccagctagccatccgcggggatgaggagctcgacacgctcatcaagggcaccatcgccggcggtggcgtcatcccccatatccacaagtcgctcatcaacaagacctccaaagag

SEQ ID NO: 4764 - DNA, 678 bp, Oryza sativa
atggcggcggcggcgcagaggctcctggcggccagcacgaagatcgtaggggtgggccgcaacttcgtcgcccacgccaaggagctcgggaaccccgtccccaaggagccggtgctgttcctgaagcccacctcgtcgttcctccacgcgggcgtggccggcgccgccatcgaggtgccggagccggtcgagtcgctgcaccacgaggtcgagcttgccgttgtcatctcccagcgcgcgcgcgacgtccccgaagcatccgccatggacttcgtaggaggttatgcacttgctttggacatgacagcaagagaacttcagtctgcggctaagtctgcaggtcttccttggactttgggtaaagcacaggacaccttcactccaattagtgcagtgattccaaaatcagatgtagctaatcctgatgatctagagctctggctaaaggttgatgatgaacttaggcagaagggatctacaagtgatatgatattcaagataccatctctaataagttatatcagttccatcatgacattaatggagggtgatgttatactgaccggtactcctgagggtgtaggcccagtacgaccaggacagaagatcaaagctggtataaccggcctcattgatgttgagtttgatgttcagaagcgcaagcggtcattttctact

SEQ ID NO: 4765 - DNA, 564 bp, Oryza sativa; identical to SEQ ID NO: 4755

SEQ ID NO: 4766 - DNA, 2811 bp, Oryza sativa
atgttccgcagcaccgtccccgagcgcgccatgttccccaccgcctacacctacgatagggtgtttggtcctgattcctctacaaggcaggtctacgaggaaggagcgaaagaagttgctctatcagttgtcagtggaatcaactcaagcatattcgcgtatgggcaaacaagcagtggcaagacttacacgatgaccgggataaccgagtatagtgttctcgacatctatgactacatcgaaaagcatcctgaaagagaattcattttgagattttcggcaatagagatatacaatgaagctgtgagggacctcctgagccacgacaccacacccctcagacttcttgatgatccggagaaaggaactaccgtagagaaactcactgaggaaaccttgagggacaaggatcatcttaggaaccttcttgctgtgtgtgaagctcaaaggcagattggagaaactgctttgaatgaaacgagttcaaggtcccatcaaatactcagattgacaattgaaagttctactagacagtatttgggaagaggcaactcaagcacccttgtagcttgtgtgaactttgttgacctagcaggaagcgagcgtgcatctcagactgcttcagctggagtgaggttaaaagaaggtagccatatcaatcgaagtcttcttacactgggaaaagttgttcggcaactcagtaagggaagaaatggccatatcccctacagagattcaaagctgactcgtatattacagtcttccttgggaggcaatgcaagaattgctattatctgcacaatgagccctgcacggagtcatattgagcaatccaggaatacactattgtttgctacttgtgcaaaggaggtagttacaaatgcacaggtcaatgtagtgatgtctgataaggcactcgtgaagcatctacaaagagaacttgaaagattacaaagtgagattaaatttccggcgccagcctcctgcactactcatgctgaagcattgagggagaaggatgcacaaattaaaaagctggagaaacagctaaaagaattgatggaagaaagagatactgtgaagtctcaacttgactgcttgcttaaaagcgattgtgatgaccatagtgacggccgcgttgcgaagcgatgggatgagcatagtcgatcctcagagtcttttgcacggaatgcgtctgaagaagcattttcagtttcagatacttctggtgttccttaccaggatcaagataatgctgtgtttaatggatcctatgtcttcagtgatgaccgtgatgatattgtattccctgttcaaacagtggatcttcctgaagaaacaaagcatgaaaaatttatgtcaccttggcaccctcccagccaccatagttcttctgattgcatagagtcatatcatatgacagaagcggcttccagaactgcatcagaagtctctgaagagcattgtagagaagtccaatgcatagatatacatgagcatagaagaagcacaagtcacaaattcgaccttttgctgccccaggacaccgagttccaaacacctgaattagagatctccaaagaagcagtccctcaacctgatgaagaccaagaacttgagagcataacaaacagaatggaagatcctaccaggatgtgccctgtcgaggaggagcaacaagatgagatcgtagatacatgtgaatctaatggtaccacagacaatgatgtcaagctatatacatgtgattctaacatttcttttgacattcagaaaccttaccctaatggatgtctgactgtaaaaaggtgtatactgagctccaaggatagggcgttgtctagaagtaaaagctgcagggctagctttatgattattccaaatagttggtttgatgattccgagtacaccagccagacaccacctaatgaaatcttgaagcataccccaagaaggtttgacaaggttaggagaagcttgtatccagaaaatgataacccttcttcagtagaccgttctgagttttctggtgaagtttcttctgatgaagtagtgaaggacatgagcaccattgatgaagtagccaaagacatgtgccccagcgacgcagaacaagaaactctcaccagtgacatcagttgtctcaccaagttgaagaagactgatagtgaccatgaggatgaacttgatgagtatcaggatcagcagtctattagagatggatctacaaccttgagaactgtcaaagatgttggcatagattcatcactgagtgcctctccttctcgttggcctattgattttgagaagatgcggcaagagattattcagttgtggcacgaatgcaacgctcccatcgtacacagaacttacttcttcctcctcttcaagggagatccagcagataacatctacatggaggtggagcacaggagactgtccttcattaggaggtccttcagtgccagccctgcaggaggcgagcttaattctgccgtcgtatcaagcctgaaaaatcttcgacgcgaaagggacatgctctacaagcagatgcttaagaagctcaccaatggggagaaagagcgcgtttacgctagatggggaatcgatctgagctcgaaacagcgaagattgcagctatctcgtctcgtctggacgcagaccgatatggaacacatcagggagagtgcatcccttgttgcgaagctgattgagctgctggagccagcacaggcactgaaggagatgtttggactgaacttcacactagctccccgatctgaacggcgatccttcggccttctaggtacc

SEQ ID NO: 4767 - DNA, 348 bp, Oryza sativa
atggcgagacccgccatcgtggcggcgcccgcgctgctgctgctggcgctgctcatcgcgctggccaccgggggagccgacgcggcgccgggcgaggtgccgctgagctgggagctcggggttgtcggcgccgacgacgcgttcggcttcccgggtgaggaggcggcggacagcgccaccgcggtggtgcggcgggtgctgcagcaggggagctacatcagctacggcgcgctgcggcgcgacacgacgccgtgctccgtgcgcggcgcgtcctactacaactgccagcccggcgcggaggccaacccctactcccgcggctgctccgccatcacccagtgcagggga

SEQ ID NO: 4768 - DNA, 553 bp, Musa acuminata
  misc_feature (12)..(12): n = any nucleotide
  misc_feature (510)..(510): n = any nucleotide
  misc_feature (536)..(536): n = any nucleotide
ttcaaagatttnctccagatcatgaaatcgtccctactattcagctagtacacgccaactattgcattcatggcataaacgaagtctcagactccacaagtaaacaaggtagattgaaggttttccacgccaggagtagcaggtcactctagtagataccaagcggcataattgcaattaccagtagagaagcagctttcttcggcgttgcacttggctacaggacaccatcatatgggagaaatccgtggcggagggcagcacgccacattgtctctatgttgctcaccgtctcaccacattcattcttgttccattgctccaacgcatgaactattccggccacacgccatgcactcatcacccttcttggcaaccagttctcacaggcgtgcaggttttggtatgcctttgggaccagcattgcaggagtgcagtggtagatacaatcttctcgtactactctgggggggattgagaataagggatgaaatggatgccttcactcgngttcctttgttcttgggcaactcacnccattcccaagtaacca

SEQ ID NO: 4769 - DNA, 496 bp, Musa acuminata
atttatttcactactatttaaatgtcatcgtatagggcctgtttggtaaatccactacagtaatttgcatactctatacaaacaaagtgtgcagacgttctttttcaagcccaatagtggtaaaataaatccattcaggcataagatcacagattcttcgtgaagcatggaatttccgatgataccagctagaaggtgattagattgctcttctgttgcttatgctgtttttcaggattttgatcctcagaagtgctccctcctattttaccgaagatcatctcatcaagatcatcaaggatgccatcatctccacctgaccttgtttcggaacctggtggttttctgatgagggcatcttctctggtagctcgaggagactcctcaggttccacggcaactggtatcactgcgggctctggttcagaattcacaacaggaggcttccgcagctcttcatacttggagaggatcttctgaagttcatcatttacat

SEQ ID NO: 4770 - DNA, 364 bp, Musa acuminata
attcctttctctataacatttatatttaaactgaactgaactgaactgaacaaactcctaacaatttacaactagaaatgctgaatacttggctactcgtcgtcctcgtactgcaacaagctgaaccctctcggttgtcccttcaacaggctctcctgaatccgctctttgatgaccgttcccatttgatggcagccttcctcaaacttttcaagaaaaccagcaacccagcgatcggcgttttccacccactcgtcgtgaagcagccccaacttcttccccactttttcttgctgttgtttaactttgtcatacagcttctcaaattccatgttcaccctcagccgtttttccttcatatagc

SEQ ID NO: 4771 - DNA, 561 bp, Musa acuminata
  misc_feature (10)..(10): n = any nucleotide
  misc_feature (37)..(37): n = any nucleotide
  misc_feature (421)..(421): n = any nucleotide
  misc_feature (452)..(452): n = any nucleotide
  misc_feature (553)..(553): n = any nucleotide
atttggttgntcttagtatcttgcaaacaatatacantatgttttcattatcaaaagactacttcaataatatcatccatgtatgaaagctaaacttgatggtaaggaaatgtattcagcaaactcccaaatatttttaagcaaaatatgaatggttttggcatgacttctaccataacatgagtgatgtctcacttaatctgcatattaaagaaatctacagccttaccagccacccatttgaatgagcctacacctttgacgacacccgtgttagcagagatgagcagtgcggtggtgcagctacaagtttctatgactatatgcatcacctgacgggtccttcaaaagctcagtttcaaaatcttgtatctagcttcaactcttccataactgacttccatccatttagccagttttntctatgcaactgtgtaaattttcagtatttntgatgtgtcacacacaacaaggtttctgagtcagtcggagtagtacacagccaattgacctttctgttcatgttaacagtcaacttaaatgagtgctgcanttgcttgt

SEQ ID NO: 4772 - DNA, 593 bp, Musa acuminata
aatgattactcgacaattgcagatatcaactacagaatccatttccaatttacaagatagggtagaaacagaactaagcaactcatcgcaacgtaatcatccacttatatactacagaacgaagcttggatctatgagtacatatagcttctacagatggttaaatagcacgtctcctgaattctattactggtacaataacgctcccttcaaatggcataaattctgtcaatctcagaatcagatatctccgagttatgttgccatgagtttgaaccgctccttgattttgtcctcttcctcatagcacggctgtgcttcgatttaaccacatagaaagtcatggtcccaagaacaccagtcattattaggccacctatcagtgtaaccagaatagctgcccatcggatatgccggcccaacacaatgaatgaagatgcgataaaagcaacggtagtgcagacagaagccaaccacatcagcttgttaattatctgaatgacccgcctctctgcctttgtttctcccctgacaagtgttatctgaaccaccaccactgctaatgaagtgaacagggcatagcattgaaaatg

SEQ ID NO: 4773 - DNA, 555 bp, Musa acuminata
  misc_feature (5)..(5): n = any nucleotide
  misc_feature (8)..(8): n = any nucleotide
  misc_feature (476)..(476): n = any nucleotide
  misc_feature (538)..(538): n = any nucleotide
ccgtntcnacttggcattgctataaacatgatccactttacaatgattgccaaaaaaatggaaaagaagctttggagtggctgccgattatggccaaatccaactcttgaggttacgcaatatacttatgcacagttcttaagagctcaaggtgtcaagtttacagatatctcttgtgccaccggagggctgtgtgtttcctggtatgaggggatgacaagccgctgtaaggacctcagagcagttgtcagttgcgcaaatgaagggcgcaggtttgggtccgtttggcagcattcccaaatgatgcttgaaaccaggggatcaacttcttttggaatgtcaagtcgtcgttcctgaaacccaacagcaccaaccacttgcattgggttcattccactccatggcatcctcagcgttgcaagttcccacaggattactccaaaactatagacatcgcacttttcattggaattttncattgcgcaacacctctggtgccatccactcaggtgttcagctgtggatttcgatgataganatgtactatgcttcaag

SEQ ID NO: 4774 - DNA, 473 bp, Musa acuminata
  misc_feature (376)..(376): n = any nucleotide
  misc_feature (467)..(467): n = any nucleotide
gtatttaattaattacatgtttggtaaaaaaaggtttcttttttctctttgcttgcccatcttggcatttgtattccttgatagcccgtgagacgcctcccaagaacgagagccatgacgttgtcttcaggctcgtcggtgcgcgctctgaatgaatcaaaaagaagaaagaatgaagaaatgctgtacccatcttgtccaaccctgcgatggtttggtttcctaggaggaggaagccgccggagttgacatttcctgtatttgtatctgttgatccgacaagcgatgcagcttggcgaacacgcccactagcggcgcggtgttgtacgtgcatgcctccgtctgcatgtaattcccccgctgatctctgaacttntcccgggagtcagggccgccgacgagagcccccggtgatcacggttggggtttgggctttcgccgggccgtaccagtcgtagtagccctgnatgcaa

SEQ ID NO: 4775 - DNA, 625 bp, Musa acuminata
  misc_feature (2)..(2): n = any nucleotide
  misc_feature (6)..(6): n = any nucleotide
  misc_feature (8)..(8): n = any nucleotide
  misc_feature (323)..(323): n = any nucleotide
  misc_feature (328)..(328): n = any nucleotide
  misc_feature (341)..(341): n = any nucleotide
  misc_feature (359)..(359): n = any nucleotide
  misc_feature (366)..(366): n = any nucleotide
  misc_feature (533)..(533): n = any nucleotide
  misc_feature (544)..(544): n = any nucleotide
  misc_feature (566)..(566): n = any nucleotide
  misc_feature (570)..(570): n = any nucleotide
tnaganangttgaattgtaagataaaggtgtcataacatgactgagaattgacatccaaaactaacgagcagcaaaattagagaggcaatgatatagttcttaaaacagaaagaagctaaatttgctgcaaaaccaaacagaaaatgatatatagtcgtcctttcgaacagaaagctattgaatcatcatcatccaccagtgaccaattctaagaagattctgccatgggggctggcaagaaagcccttccaggtcggcgatcagcgactggaccatggcacccaagcaactttgcatttacaccatctgggatgattctgtnctcantcttccacttcanatagtcagcccggctaancttagtnaagccccactttccactgatgattatcttttgacggccaggaaacttgaacttggcacgacgtagggcttcttgagcattgttgctattactatccttgcagcgaacagagagaaggacctgaccaatgctcaccctagcacatgtcccttgaggctttccaaaagncccacgcattncagtctggagcctatcagctcngttnctgaaagcatcttgttgatacgtaagacatggacgggtgcactcttcacccgtag

SEQ ID NO: 4776 - DNA, 532 bp, Musa acuminata
  misc_feature (4)..(4): n = any nucleotide
  misc_feature (59)..(59): n = any nucleotide
  misc_feature (140)..(140): n = any nucleotide
caantgaacaggagaacgctgacttctgactgaattaatgtgtctctctatacccctanagtatttttggggcgaccaaaaactaccaaattattccacaaacccaaaataaatgtggctgtagtgtgattcaaaccccnattgggaagcattatattcatgcagatgtaagttggtgctgctggtactgagcttctgattgtttatgaacttatcttagagtatgtggatgacaaaatcttggttgttttttaatgttgttcttgtgaggtgttttgtggcataaacatttactatcttctagctgcttaaatttagttgagagagaaattagttagccttacaaccaaaagccttatctgtcggaagaattatgattacatgttacacatgttcattcattccagattgctaatcatcttgatcgtgctgttgctagcttgggaaggaagcctctgaaggttttggttcaagtaaatactagtggtgaagaatgtaagtctggaaaacaatgtattatttatcattgtgg

SEQ ID NO: 4777 - DNA, 612 bp, Musa acuminata
  misc_feature (2)..(2): n = any nucleotide
  misc_feature (7)..(7): n = any nucleotide
  misc_feature (98)..(98): n = any nucleotide
  misc_feature (581)..(581): n = any nucleotide
cnaccgngtaggatgatttatagattaatgttctgtcgaacattaatttattcatcaatagatgtattgacaagcaagacacacgaaaagtgttcganaacacaatgctcaacgtagatcatcaacttcttcagctggcatgtcctacagccttacataatctccacatctccatccaaacgctgcttttgtatctgaactcccatgtaccttcccagcatcatcacggtagcttggggattggttccaggggagaaagtgaaggtggagccgtcgatgactcggagagcatcgacgccgagaaccctgtagtcatggtctaccacctggccgacttggcacccgccatggtaatgccatatggtcaacgcgaggtccttgcagtactgctccaaggaggtggagtcatcgtcgtgcctcgttcggttgttgacgatcaagcttgcagatagggttatgagatcttccacggattgattggagttctgaactcggacatctcttttgtctcgatcactctctttatcgtctccatgccctccacgcacgtccggacgtctcgggttcacgaataattgaangtgacggcgggattgtcttctggatggagat

SEQ ID NO: 4778 - DNA, 596 bp, Musa acuminata
  misc_feature (22)..(22): n = any nucleotide
  misc_feature (118)..(139): n = any nucleotide
  misc_feature (366)..(366): n = any nucleotide
  misc_feature (521)..(521): n = any nucleotide
  misc_feature (523)..(523): n = any nucleotide
acagtctcccctatgcgttaanttcgtccagctcttttaggtttaagttactgctacttgagtacttatggggaatgccgatggcgtgttccccggcacggagtttgcgcgccgcgtnnnnnnnnnnnnnnnnnnnnnnttcctcgacaccttcaggaccaacctgaaggagaccttcttccccgatgaccccctccggcagttcaggaacgagcacggcccgcggagggttatactgggcttgaaatacttcttgcccatcctcgaatgggctccgagctacagtttcggcctcttcaagtctgacctcatcgcggggatcaccattgccagcctcgccatcccgcagggatcagctacgcgaantcgcgaatctgccaccgattcttggtctatattcgagctttgtgcccccgttggtgtatgcgatgatgggtagctcacgcgacctcgccgtagggacggtggccgtagttctcttttgatcgggtcatgttggggaacgaggtctcccctaccancngatccggcattgtacttgcacttggccttcactgcaactttcttcgtggtcttttaaggggcttggggttgtt

SEQ ID NO: 4779 - DNA, 600 bp, Musa acuminata
  misc_feature (2)..(2): n = any nucleotide
  misc_feature (8)..(9): n = any nucleotide
  misc_feature (13)..(13): n = any nucleotide
  misc_feature (15)..(16): n = any nucleotide
  misc_feature (20)..(20): n = any nucleotide
  misc_feature (22)..(22): n = any nucleotide
  misc_feature (35)..(35): n = any nucleotide
  misc_feature (62)..(63): n = any nucleotide
  misc_feature (65)..(65): n = any nucleotide
  misc_feature (71)..(71): n = any nucleotide
  misc_feature (76)..(76): n = any nucleotide
  misc_feature (81)..(81): n = any nucleotide
  misc_feature (85)..(86): n = any nucleotide
  misc_feature (88)..(88): n = any nucleotide
  misc_feature (142)..(142): n = any nucleotide
  misc_feature (214)..(214): n = any nucleotide
  misc_feature (230)..(230): n = any nucleotide
  misc_feature (386)..(386): n = any nucleotide
  misc_feature (582)..(583): n = any nucleotide
cncgaagnngaancnncgcnanattcatttctctnaaaagcaaatacatagtaatgatttcnntnccacgnaccanaacantggnncntcggcaaacgccgttattgtttaacatgttaattaattaggtggtgacgtccancgtagatcttaatcgagactcaaatctcgagttggcgttgcagctcccaaagggtgtcggcggaacgctganacgggcagcctcctcntcgctgagctggatattggcgacgctgaggacgccgctgcgaccgagctgggcaggaaggctgaggaagacctcgtggtcttccggaatgccgtagaatcccttggcgagcagagagacgggatggatgcgggtgctgatcgcgaagaagggatcnggcgaggctggccaccgagtaaccgatgggcccaagatgtgtagcctttgaggcggatcacctcgtacgcgctctccaccacggcttcctgatcctctctagcactcttgctccattgcagctttgtctttcgtgagctggctcagtatgggcactccccctacgctgatgctggaccacagtgccacgagctgtnncgtgctccctaccatgt

SEQ ID NO: 4780 - DNA, 553 bp, Musa acuminata
  misc_feature (488)..(488): n = any nucleotide
  misc_feature (520)..(520): n = any nucleotide
  misc_feature (545)..(545): n = any nucleotide
gcttgtataattaaacattacattatatagctagtcgttggcaatacagcatccctatacatcaggtgaataaataatacaccttggattccactgtgttcaatagcaaatctatggcagaaagctgatggaaattgaagcatccttggtacatgagcggccttggaacaaaatgctctcgaggagctcctctctcacatctcgatgtcctccaagtctggcaaggggaagcgcagtatagctgcaactcccgtcaactgtgccagttgttctacagatacatgcattgaagaaaaaatatgtacggtgccacctgaatccttgactgattcgacaaacttaacatacttttgcctcgtcgcaatgtcagaatttctaaaaaggccatctgtgatcagaagagtttggatggccatccgctcatgtgcaacctcaacatgctttggcccataacaagcgcgtgccgtatcatttgaaagcatagtgcngaagtctttcaaagcacggacctcctgcgcanttttttgtgtcttttatccaagacnttaacggt

SEQ ID NO: 4781 - DNA, 610 bp, Musa acuminata
  misc_feature (4)..(4): n = any nucleotide
  misc_feature (6)..(6): n = any nucleotide
tcanangttgggatagaacattatcaaaccatttagatctatcattacaatacttttgttaaagatatacaactacagtcaatacacaatggtgaaatatcaagttacgcttacaaagcaaaagaaaaaagagaggtgatggcataatgactatacatgatctcctgattcaaagtcgccatcgaaccgtaacaattagatccaagtagccagttgatttagcaatatctgcaatggaaccttcggagtaggccgtaagattgtggaagcaatgttatctgtctccttagtcacgaggccgagcaagccaaagagagctcagggcatgaagccgtgagaagtagtcattgatggcaagaagtgctcgtgcagcttgacgagtagttagtatccgacacatttgttgtagagtctgttgccgcaggttgtcagcctggcaaaggaaattttcgagagtcccaagtttccccatggccatagccatctgacccatgtagttcgcaacgttgcctgaagaccccgaggagctaagagacccagccaatgtttctgccaaagactgctgcagtgcctccatcccctgcgagagagcatcctcgggctgctgaga

SEQ ID NO: 4782 - DNA, 542 bp, Musa acuminata
gatatatacagcataccatgtattgatgacattacagtgcagaacccaaaaccgtaccaactatatctggccagtatttatcgccctatgcatcatccttgatgaccaagtgttcattagggtttcaaatgtctgatagagatgatgtgtgcgcacaacaaattgcacaaaatgttaacattgtaacgtcgaacaaaggtcatccagagcagcatacaaaggcagagcggctttcggttgctctacagtccccacaagtatgtcagtagtagtcagataaggatcaccatagaagcgtgtattagcatcctgacgggtcacaactaggtttccttcaagcgacactccgacaaaagcacctttgctacagctgtaagtataacacattcctgatcctttatctccagctcgaagatctgcttctaagactcttccaacaggtcctgctgcagcactcagtcctgccccaagggagaaatgcatacggctgcagaatgtcttcactgctttagaaccatgaagcactatgatgtagtcatcag

SEQ ID NO: 4783 - DNA, 440 bp, Musa acuminata
  misc_feature (24)..(24): n = any nucleotide
  misc_feature (30)..(30): n = any nucleotide
  misc_feature (51)..(51): n = any nucleotide
  misc_feature (54)..(54): n = any nucleotide
  misc_feature (56)..(57): n = any nucleotide
  misc_feature (65)..(65): n = any nucleotide
  misc_feature (100)..(100): n = any nucleotide
  misc_feature (105)..(105): n = any nucleotide
  misc_feature (164)..(164): n = any nucleotide
  misc_feature (167)..(167): n = any nucleotide
  misc_feature (177)..(177): n = any nucleotide
  misc_feature (183)..(183): n = any nucleotide
  misc_feature (189)..(189): n = any nucleotide
  misc_feature (192)..(192): n = any nucleotide
  misc_feature (379)..(379): n = any nucleotide
  misc_feature (393)..(393): n = any nucleotide
gaatcgtatagaacattacaggangctttncatgttatcagaatagaaganaantnngaaagaanagcctcttttcgtggaaaactacttaatctcatgntccanatcgagcttaatcggtccatgagagctccatcaccttggccgcgaactatagggggtcnggnagcttcatcnatcatnggcttnccncgtacggccagctccatgacctccctttcgctcgatgcgggcgatgatcgggttgctctgtggactggctgccgagacttgtgcagagaacatattgtatggttgcaagcaatttgagtgaatgcaaaggcacgacacgatcatcatggatcagcggtcaacagcatggtggattggtactgaagtngatggctatcaacntttctcccatggcctttttacattgtgtaaggtgagtacttaataag

SEQ ID NO: 4784 - DNA, 588 bp, Musa acuminata
  misc_feature (536)..(536): n = any nucleotide
caggacagtatgtcctacattggcatatggctcttacaaagttcagaagaatcacagaaactagttaggcacaagttatattaaagatgaaggcaccatatctgtacgaatacctaatgtttcttttgatgttgctgttatgactgactattgattaaggcctgatgccatctattacagtcgggttttcttctttacccagagcaactactgcttttttaagaagagcttcagttggcaaatgggagttctccactgccttggagattgcttgccatttttctccatgctttggttcagcagccatgcatcttttcaggacatccttttgagtttcttcagtaccatgctgaagttcaaacttgtagtataaggcccagaaatctccaacatcaggagcaagtgtaactgccctgttgaaccagttccttgccttatcaaccttcctatcttgccaaaacagttttgccacagctgaaatgacatatggatcatgatcgcagcgcttaagagcatcccgactctttgtcttgcgntgaggacgtggaaccatctcaatggattccgcccatagtatcccacttgttg

SEQ ID NO: 4785 - DNA, 467 bp, Musa acuminata
gtgttgctggtgtgctggatgggcatcaccaggttgggaggggcctgcccttgcaagctcgaagccattgtggccatcaggggttggctaagcttgttgttctcatgcgccaacgcgttgcagaaggctcggtgcgtcatgaagctgtctctcctggagaagatggtgccacagtcgcatttgtactgcctcgtcccgcagatcttggagtgagccttccaatctgactgcacggcgtatttcttcgagcacttgtcgcacttccacttcttctcgccatgcttgcggcagtagtgcttcttgattccggtaagatcgccgagggcgcggctggggttgtggtgcacgcatgtgggctccggacacacgtagaccttcttcctggcctcgctgccgccgtttcgtggcctcagcttccacggaaggttgtggcctcggcggtgcagttgcaggttttggtccctctg

SEQ ID NO: 4786 - DNA, 466 bp, Musa acuminata
catgtcttcttggctgcctgcattttaaatacaacatagaatcgaaggggggacaagagaacagaacactacttagagcagggatgtctgatacttcatcacatatatgtatgtatctgtttcttgtaattgatcatccagagtagactgctgcccgtttctacacttttgatccagtcgacacttcatcccctgtggccggaggagcggtaattggctcgaggcatctggcccttctcgatgaggataatgtccgccaccagcagctcgtagtgccgcttcacttcttccgctgacttgccgccgacggcgcgcgccacgttgtgccagcggtcgggcgtgtccttgtcgtacaccgcgagggctttctcgaacatcttgttctgcttcgcggtccagcacgagctccccgagctggttgccatctcgaagctctgatgtgggtgagagaagctgacgagtcggc

SEQ ID NO: 4787 - DNA, 700 bp, Musa acuminata
tttctaccagtggcttttcagcactgtgaacagtcatacaagaagacattagtgaagaagagacgactggaagaatttgatgaaacagagtaagctctaaagaataatggtacactgagttggattgctcttagtgcaatacaaagatcaacaatgaaggttgcaatatctcagacaaaggtatcagtctgtgaagagataccgcaatattagcaaactgtggactccacttgaacttctaaaagaaatatcttaacaattccttcctagaggaaaatctaaaaagtacaagcaggcttaataagatccacaactatccagcagaaggtgtggcataatgcccagttttccttctgtggcggctgaaatcagatacaaacctgaatgtctgcccgcacccagagaacttgcacttgtagggacgctctcccgtgtggaccctgacatgttcggtcctggcccatgcccacttgaaggtcatgttgcagcccttccatgggcatctaagaggtctatcatcattgtgaacacactgatggcgcactgcatatttgtgacagctaaatcgctttccacatccctcaattgtacaacggtcacgcttgtgcagtgaaagttctccccttgtctgaaaacttcataaaacagcttcaatgtcacacttgaaagccttgctcttatcttcctttgcacaatcgag

SEQ ID NO: 4788 - DNA, 529 bp, Musa acuminata
  misc_feature (3)..(3): n = any nucleotide
acntaatgaaagttaaaatatatgaccaaagtcaccttccttcaagtacacatcaaaaggagtctgttgtactagtgaggccatccttgtcatgaaagctttcaggcctccaacaaaaaagggaggaaaaaagagagagaaactatacaaccgagttaaggaatacatttccaactccaaaccccatttaataattatttatcatctctcacgtgtttgcaaccgccaacacccaacttacaaattctggatttggcatacacccgactgccatcagcaaaaatgctgcatccgctacaccggtatgacatcgagctttgaagtatcttcacacctcaacacaatcccatcaagattagctgggaggatacaactggtccattggcatcctgtcgaaattggctcagatggaggaacaatcataagcacattgtcattcttccgaacgactcccatcacactcacagtactgccttccttgatatacccttctttcatgcgcattacacgatcatcacttgaaagattc

SEQ ID NO: 4789 - DNA, 820 bp, Musa acuminata
  misc_feature (811)..(813): n = any nucleotide
  misc_feature (817)..(817): n = any nucleotide
ttatcatgataaatttgcatggacttgacttcttacatgttagcttagtgataacgtacaactaagtgatgcttgcatagcacttgaacaacaatactctctaacgacagtgctctaattttgtttaaagcctcgtatcaggcaactctgcttctgctggtccgccttcatccgccacttcgataggtggcatgactctcttccagaaccagtgcttcctccacagcagtatcatctcctcgataggcacccctttggtctccgggaggaagacgtagacgaagacggtcattatggtgatccaaccggcgaagaagaggaagatgccgaacttgaaggagcagaggaggctgaggaaggactgggcgatggcgaaggtgaagaggaggttcaccgacaccgtgatgctctgcccggccgacctcgtctccagcgggaatatctcgctcgggaccgtccaccccagcggcccccacgaccacccgaaggcggcaacgaagaggcagaacaccacgacgacgacgatggagaagtctttcgacagctgcttgtcgccgccgaacttgacgcctagtatgacggccactgcaacctgacacacgatcatctgtaatccgccgccgatcagcagcggtcttctcccccacctgtcgacggtggcgatggaaacaagcgtggaagaggcgagcacggagcagagttgcctgatacgaggctttaatcaaaattagagcactgtcgttagagagtattgttgctaccgatgcactgttcgagtgctatgcaagcatcatttagttgtacgttatcnnnaagntaa

SEQ ID NO: 4790 - DNA, 459 bp, Musa acuminata
  misc_feature (280)..(280): n = any nucleotide
gctttaaaagattgattttagagtctcgtaggtcatgaaaacaatgcccacactggggacaactttgaggtattcaggcaagatacctcggtataagcctcgaaatccttcggtcctaattatatgcttaaacgtcccaaagacgcctgacttatagacacaagcccttccagctgccccttccaactgcattcttcgcctcacgagatccaacgggaatgtcactgttgatgatgaaataccagaaagacttccacaagccaaactaaccaatacaggngaatcatatggcctctcaacttgccaacgagatctcaaagtttcatacacagaaaagctggttgctaatgctgggtccaacacccatcaatgttggtccaagtcccttgtataatcctctcctaacctcatctctgcagatagcatacacagcatgtgaaatgcccctgtaatacatag

SEQ ID NO: 4791 - DNA, 615 bp, Musa acuminata
  misc_feature (2)..(2): n = any nucleotide
  misc_feature (478)..(478): n = any nucleotide
  misc_feature (573)..(573): n = any nucleotide
tnatttgccttttattggtcgaatagattacgacagtccttaccaggaaacacttattcttctgcctcacggccaagtagggaaaagcctcgtgacctcattcataccgaagtcttacaacacaggtgagaaacgtgaacgaaagagaagcgaatagtctcttccatgattcatcatcatcagtcttcatctcttctcccacacgcagtagtcgttgccagaggcaacgacgtggaagttggaaggaacgagattccccacgtcgtatctcgagcctagctttgtcagtatcttcccatcgatcattgccatgtagaggtcagcatcggaggccagaatgttgagagcgctacccgaatgaattccatttcgtgttctggtttcagccaactgtgttatcgcctccttcaatccccagtcgaacatgtggtcgtagaagatggaagggacgcccggatgtgtgagtatataagcgtancttgcatgaccttatcagaaggaaaaggccacaacctttgcgtcgaaccggtatcgtggttgtcgacgaaagtgacagccttctccggccaccancccatcatgccggggcgccttcccctgggaatcacgcatcct

SEQ ID NO: 4792 - DNA, 695 bp, Musa acuminata
  misc_feature (679)..(679): n = any nucleotide
aatgttacagaagagaggtctctcaacgtagtagtttacacaaacaggtacaaataacaaccagattttgcaacaaaacgcccaaaatagaccacaagctcgttattcctcacgctcattgcaagttcaggtagattcaagggtttaacaccaacgacacgactggcagaaatagactccataaagtccatccaaggatttaacaccaaagacacgaccggcagaaaaggatcgcggctccatggccatgttcaaaagccctgatcaaagagatagtcgccaagcctctccactaccatattgcattgaccaggcgtcatgggctcattatatatgccaatgatcaaagccagattggttttcttgatggtgacaccgccagaacccttcttccctcgaataacagctcctgattccccttggatgaccatgtacttcgtcccaccaaggtataaaccagttggagcaagagacccaggttcaccgaagtctttcataattgcagcaatctcttcaggcttgcactgagggaaggcgtcgctctgggcccagacgctgccatcgtggccgacgatgggcggcggccgtgagacactggccatcgatgtcgcacaacaaatggtcgtcaacgtacgtctgccaagacatcgtccttccccttcttctccggcgctcgccnagctccaacgcgtggg

SEQ ID NO: 4793 - DNA, 636 bp, Musa acuminata
  misc_feature (16)..(16): n = any nucleotide
cactcttattatttantctttaaaggcaatagtaaactatacactttcctctgtttacactacatggaattctggttgctcgaaaatggcgagcaatgagcagctgaaccacaagaacccaaattctcgaaaaaaagaacaagaaatgcaaacaaagttaacacaacatttcaaagagaagagcatgtttgccttttgaactgctagttagtcgatcatttgatcaatggcgacttggccgaaaatatcagggcatccatcccacttgccttcttccctggcttcccagtaaccaccgatataccaatacatgtcacttcctttatcttttgcaaaccatcgaggtttccagcctctttcctgcatctttcttgcctgacgttgtcgctgttcaagtctcaacttctcagaatttgccatttcaaactccccgttctccaagcacctctgatcaggccttagtcttgaatctgttggtggcaatttttcctttaatccaggagtgagttcattgattgtcattgcaaaacgagtgagattgtatctggtaggatatttaggtggtttgctacgtttccacagtatgtgggcttcagaaaacgggtcagatccttccctttccagagcaatctccat

SEQ ID NO: 4794 - DNA, 623 bp, Musa acuminata
tatatataattggcagggtatacaaaatatacaacgtttttaataggttgaggatataaactggacaaaacctatttgaagatgatatcggttgatttttttgttcctttcacggccatgcattcatcaaccgttgtgttcgtaaaggtgtgtagagtcctctgtcatgtatgccctttttggtcatactggaaattttagagatagttcatgacttcaaacaagtcattttggttgcttataacccttgctttatcatccacaatttccaaaacctctggtcttgaattaagaactccactagacatgcccacatcaatacaccatattctttcattatatttgctgttaacaccattaaattgtggagtatggccaaccaccattccctttgctcctacagcttgcaatgtttcttccagaatagaggatatctgcaaaatttggtacttagcatctgctgaatctcttgaatacagacgattccaaacaatactatcataacctctggtagctatgaaaggaactgccggactatcactactttcactaaagtctctcatccaaaatgatacttctttgttcatcctctccaaaccatatgcaacatgatgagggagaag

SEQ ID NO: 4795 - DNA, 656 bp, Musa acuminata
  misc_feature (634)..(634): n = any nucleotide
tatatcaagcttttgagcagaagattgttaagatgtaatttaaaaagggctatgcacgattctaagacaaccttaagaagcagcaataggcaacataatgtacataaaacataggcaataattacacgaagaaactaggcttgcaacagttgcctggcttgaaagatattcccaagttgctcatatagaaactgttgctcctcaaaggtaaggttccttaatatctgctccaaaatcatctcaactgacaaactttgaggcatgacaaatgattgatggtatatgtatgcaaaaacggccatgaccatttggcaatccattctgtcagtaattccaccatgtccaggaatgctgtcaccgaagtccttaagtttgaaggcacgtttaaaaccacttgcaaagaatcctccaaatggtgctatgattgatgcaaacagaccaagagctaaagcatgccactgcacaggcaaaattgctacttctttccaaggaaaccactgatgcatgcatctaggtactgaaaaatattctggtttaaacaacgtgccaggatcacaatgcagccatccggttgataagtcctttctggacatgtaagccttggaactggccattatatttgctaacatgaggngagtcatgtcgtgttgtgccca

SEQ ID NO: 4796 - DNA, 645 bp, Musa acuminata
tacagttgcttatattaccttcagaatcttcatgctgaacaccgctgctgatttgctgaaacagttccagcaaagtcgagacttccttggcaaatcatgtacatattgttctgtagcactgtggccatcttcaagatctgaagaacaagatgaccgcagagcactcccaacattagaaatcattcgagcaatagctcattgcaaagctgctggtgagctgcggacatggccctgggttgactccgagcgcagccccagtgacgtccgtgcacttccacggcgaggccccgacgccccagagcttgacgttggagaggcatacccgagtgaaaggcgagttcttgatgccctcgatggatcccggctgctcaacctcctcaccccacacgttcttgatcgtcactccatcaaccgtcgggactgcgttgggatcaaagttctcgtcggggtggtcaccgacgtcgccggcgatcctgatggccttccgaacgttgttcatgttgacgtcgctgatggttatgtttctgatgtagcctcccctgccgacgttggtcttgatgtggattccaatgccaacgtcgtagaggttgatgttctccaccaatacgttctccaccccgcctgaggtctcgttccgatgggatg

SEQ ID NO: 4797 - DNA, 584 bp, Musa acuminata
  misc_feature (39)..(39): n = any nucleotide
  misc_feature (74)..(74): n = any nucleotide
  misc_feature (77)..(78): n = any nucleotide
  misc_feature (80)..(80): n = any nucleotide
  misc_feature (84)..(84): n = any nucleotide
  misc_feature (86)..(88): n = any nucleotide
  misc_feature (91)..(91): n = any nucleotide
  misc_feature (94)..(94): n = any nucleotide
  misc_feature (162)..(162): n = any nucleotide
  misc_feature (549)..(549): n = any nucleotide
ataagtaatcagcaatcggtccgtctacaccgatgacantttttcactgatatcgtttcaactatttcctaccngtnntntctngnnngtnaantgagttcagtttcagcagcacggcgtttgatcaaagcacaaaagcagttgaaaggtatgaccttgttnactttctggtcgtgctgccggaaaactatctccaagataaaaacagctgctcgaaatgaaatcgaatcagatccagcggtcgagccacactcttgcttgggaagaggtaatctttcttttcacaaacgtagtctaagaactccataaacaaacagatctgatcatgtcaagttagcgactttgtaaccctctgtgcataagctactaaatgcaaactggaaagtagccaggattttatcctatcatcacctagtgttcaagtccagctccccagcttctcgccattcaccttgttctccggtgtctccattctcaggttcattctcatcattcaaaaaatcctctgatggctcttcatcctctctttgagatttccccacccatgantttcgtccatgttacctgctgttcttgccccatat

SEQ ID NO: 4798 - DNA, 530 bp, Musa acuminata
  misc_feature (473)..(473): n = any nucleotide
ttaacaatgaacctaaagataataaatgcttatgccaataccatatgcctactacagttgagggctaaaagaaactcactgcagatgacagacaatgagccaccgcatatgctacagttgaaccaaccaataacaaatctcaccaaaggaaggcaaaaaacatgagctcatctaaaatccaccctatgggtagggtttggatcacaaggttgtcgacactgaatccttactacgctccatcagccagtctatctagaaagctctgcaactccctaagcccctctcctgatatactcctccgaactcgaggccgcggagcagtcatgaccggcggcggcttggtttggaagcacaccaaaaccacagcgagattgtcgctgctctccctcttcagcgcttcgtcgacgagctccttacagcatgtggtcggatcgttgtgctcttggagctttcggcggcgccaagtccacggngttctggctacggaagacatcccaggaaggccatcacatcccaggatcagaaactcg

SEQ ID NO: 4799 - DNA, 628 bp, Musa acuminata
  misc_feature (4)..(4): n = any nucleotide
  misc_feature (621)..(621): n = any nucleotide
aaanataagaaagagataatgttgttgttacaccccaagacatagttttcacacaacccacacaatggaagggttggcagtaccagcgtgccaacatacagaatgatgatcacagaactaaaagaatggaatagttactttagttaatgatacatgcattgagtcacttatgatttccgcacaaaatcttgctcctgacagttgatgacatgtgacttaaacacggagacaaaagatgcaggatgtcatataatttgacaagccctgaaagcttagtggccggcaggatttctattccatgacaagtatgaaggatcaccaagcttcctaggttttaccaaatacacgatagtgaaggccacagctaaaaagaagcataaccctccaacagccagataagcaatgccaagaaagtcattttttccaccaagccaacttgatgtggaaagcaccaatttcttcttgccactgaaactgtatgtgttgtaattgttctctaatgtaacagtaatgacatcacccgcattcagatcctgctcaatcttcccatacaatttcctaaatgttggaagagcagcagtgcgcatccagacaatgaggtcttcctgctcacttaaaggntttgtag

SEQ ID NO: 4800 - DNA, 574 bp, Musa acuminata
attttcacgattgtcacttccaaagatcaggtttctaaggcaaactcagatctacacaggtaggaaagaaaggcatggatcaacacatgaagagttaaagagaggaaataccacgacacgagagagaaacaagaaacatatccgagatcgacgatgccacgaaccgaacgatttcaaggatttagggttccacggtgatgacgagggagtcgactggatcagagggaggaaggtttgggattctcctcgtcgtggagcacgggctttgtgagcatgagcgggcggtcgttggcctcctcgaggtcgtcgccgtcgtcctcggtggtgctgaggttgatgcaggagcagcgctcgagggaggcgaagaaggcggacaccacgctcgctcctacccacatcgccaccccttccagcttcccgtagtcgacaccatgctctgggagtcatcctccgtcgccatctgagccgcccgctcccggatctcacgacgccgggtttcgtctcctgcttcggttcgtgacgtgtaaggagcaatcggaagagaagccaaaaagaaagcctcagagtcagagaa

SEQ ID NO: 4801 - DNA, 538 bp, Musa acuminata
  misc_feature (127)..(127): n = any nucleotide
  misc_feature (151)..(151): n = any nucleotide
  misc_feature (207)..(207): n = any nucleotide
  misc_feature (209)..(209): n = any nucleotide
  misc_feature (481)..(481): n = any nucleotide
  misc_feature (494)..(494): n = any nucleotide
tgagaccgaaaagcacaaacattccaagaacaagaaggatgtctagttattctgccttgttgcagcacaagaaagccatggaatgggatactcttacttagttctagcgaggttaacctttagccanggaactcttccatgaaagcttcanggaacgccttgagccgggatatgatggcggggatttggtcctcctgcggcaggatngngcatctgacatgccatgttccaggaacctgcccaaagccggatccaggaacgacgacgatgccggtggcgtcgagaagacgtcgagcgtagaatgcatctggtgctgcattaactgctttggcagctgcgatagccttctgcggtaggcgcaggcgaggaaagagatacattgcgccctctgctttgttgcagctcacgccctctaagctgttgaatgcatcttccaatgccttggcacgtctagctagagacgaaagaatcccatttttcnccgcattgaaagnttcatatgattcgtctccgacctttgtggattcataacaagact

SEQ ID NO: 4802 - DNA, 769 bp, Musa acuminata
  misc_feature (627)..(627): n = any nucleotide
  misc_feature (643)..(643): n = any nucleotide
atgtcattatctagtataaagttttgctagaggacaccagagtgtaattacataatgtttttatgctttaatgggctggattatgccaccaatgtgagataacaaggaaactgcttccatgatttctttgccaacttgatcttaaaacatcacttgattcttgctgcgctatttttgacttgtgtacaaggatagttttacacaacaatgggaccgacatgtagattatacaatgtgtggtgtttagtgcaaatcacatgcccattgctccggatgtgagctcagagtctccttccagctcgccctccgaaacttcgacgatgacatcacttctcttgttctcagaaaggtagtgatccaacgcgtcgtccccatgtaaaattttggctccacatcctggtttgtcaactgacccaacagcttcctcatccaccacaactgcatcaattcgctcatctccagttttcacatcaggaatctcaaacatggcctcgataagtatattctccaaaatggctcttaaacctcgtgcaccagtgttcttggccattgctttctttgcaatcaacctaagagctgcgtctgtgaaatgcagcttaacattattcatgctaaacaatttcttgnactgacgaccaagagnttctttggctctgtcaacacctgaacaagttggtcctcgcttagagctgacaaactaactagtatcgggaaacgcccaacaaattctggataagacatatgctatagatcactgctctcgacagat

SEQ ID NO: 4803 - DNA, 570 bp, Musa acuminata
  misc_feature (14)..(14): n = any nucleotide
  misc_feature (81)..(81): n = any nucleotide
  misc_feature (103)..(103): n = any nucleotide
  misc_feature (560)..(560): n = any nucleotide
tcttcagtgcattnctgccccttgtttcaggtcagtgtagtacatatatatacacaaaaaaatgcacagaagatgggtgtntagctgtccattcttttttacngttcttgttcatcccgaagaatgtgtttcattcagtttgcaaacacaactcaaatttagcagagaatagcttaatttgcagatttcacaggatgccaagccgcaaatggctacagcaaaacttgcttgaacaaaaagaaactgtgctgcctcttacaatttctggtatcagatttttccatgtacctcttgcttccttctcagcaaattagcgccttttggcgttgatggtgaactcttaaagcttctagaatgctgtcaacccacccttcaagaccagggtttttcgggtagtatacattcttcaagcccaatcttttggcagctaaaccagttgtttcgccgatgcaagcaactgagttgtcccaattctctggttcccggataagcttaacccaagcacgggctgcagaaggggaagccactgcaacaactggagtagaaagagcaaattccanaatagtttca

SEQ ID NO: 4804 - DNA, 548 bp, Musa acuminata
aactacaagcataagtaaattaacattgtcatttcagtcacttgaaccaaattcgctagagaacatatactagaactaccatttgagagtgataccaaaaagatacagcatcaagctgtatgccatgttcccttgagacctagaattaccattttcagtgaaaccagaaagacacagcattgagacatcaacaaaaacaaactagaagagagaagtccccttcccctttttgtctccaccaatctcgaagtgcttgcatctttttatgggatgctgcgaataatgcttgcaactttggcattgaagcttcaacacaatcttcttggtggtttttgccttcttgtgaaaaacaggcttcgtctgtccaccataacctgattgcttcctgtcatagcgtcgcttcccttgaacagaaaggctgtcctttcccttcttatactgtgtaaccttgtgaagagtgtgcttcctgcaagccttgttcttgcagtatgttttctttgtcttgggaacgttcaccatgactgcagcgcttggttggtgtttccgcc

SEQ ID NO: 4805 - DNA, 509 bp, Musa acuminata
  misc_feature (7)..(7): n = any nucleotide
  misc_feature (491)..(491): n = any nucleotide
aaatttnagaatctatcaagattgatatacattcaattaaattcaaggtttgagaaaacctcatagtcagttttcccatctacaaagctatcgatgttctgcattccttctaataaagatggttgaaatccatcaattctggaagggagcattttatagcataataacaacccaagaatgaaaatagcctgcagctttgtagagtccccctgaacagtgaagaatagtaacatcgacagaagaaacaagaccacacagaaatgcataatacacaataccctgtccatcagcttcccatcattaccagctggaaagcctcgagctctgtacacaaacaagaagttgtacttgtccaccacatagcggtaaccaaagtagacagcaccaacaggaaccacaagcggggcaaacaaagaatagatcatggtcagcgcaaagattgtcaggttgaaagcatagtactgtggcaaagtcaaatgtctgctttgggncatggaagctcctattca

SEQ ID NO: 4806 - DNA, 589 bp, Musa acuminata
tgaataatgatttcttaatagggaaatataatgcctgaaaatttggaaaatattgccctcaccatcatctaataatggcagccgaatgacaataaccagtttggaaacacaaaacagcataagggatagacattattatcattctgaaaaataaaaggtaggatcgatgactggcatagtttgctgcggcaaaaccaccagggaggttcacttaaaatcaggcttctctgggtaagtgcagcctgacctctgaattatcacatttgcggcataacaaccggctcttacgcagtcctcgatgctcttttcttgaaccaactgggacaagaatcctccaacaaatgcatcacctgcaccattggtatcaaccagcttctcctttggcaataggatcactgggaacaatctcacctttccatcctcagcgacaactactggatcacaaccttgagtgataacagtaattcttttgtgagttcctgatgcctttggcaatgctgagatctttaaagcaatctcctcaacattctcagtctcccaaccgcgaactcttgcaaaggtccttgcttcagtttcattcccaaataca

SEQ ID NO: 4807 - DNA, 624 bp, Musa acuminata
  misc_feature (581)..(581): n = any nucleotide
tattgcaacagaacactggcattccaggcttacacaacactctgaaaacatcaaaagacgatcttttttgcatttttgattttgctaagcagcagctcatgttaattgagacgaaaactcgcgatgaaagcctctcccttgtagtcctctgattcgtaaacagacagatcaactcagcgatgacagtgacgacgcttcccactcagttctacttggcgccattaactgcagcttctccttcaactgccagtggtacagacacagccaaattgcggtatttgagggcgtagaacatctcgaggtaacgacgagtctcacgccggtccaggttcgatacgtacttccagaaaccataaactccagtcagtgtcatcagcctctcagagtagagcttccaggtgtacttctcttcgattatttgcagccctcctagggaaattttgtcccagtggctcgggtcttccttgcacttatcaaagaagtttgtgacgatttcggcagctttgtcgccctggtaaggatcgatgtggtaaccagacaccccatccactataatttcaccaggtcctccatgaacagtngcaaatgtcggcagtccgcaagtcatggattcgacgacagtga

SEQ ID NO: 4808 - DNA, 501 bp, Musa acuminata
  misc_feature (31)..(31): n = any nucleotide
  misc_feature (41)..(41): n = any nucleotide
  misc_feature (65)..(65): n = any nucleotide
  misc_feature (126)..(126): n = any nucleotide
  misc_feature (146)..(146): n = any nucleotide
  misc_feature (148)..(148): n = any nucleotide
  misc_feature (161)..(161): n = any nucleotide
  misc_feature (174)..(174): n = any nucleotide
  misc_feature (178)..(178): n = any nucleotide
  misc_feature (189)..(189): n = any nucleotide
  misc_feature (192)..(192): n = any nucleotide
  misc_feature (196)..(196): n = any nucleotide
  misc_feature (288)..(288): n = any nucleotide
  misc_feature (365)..(365): n = any nucleotide
  misc_feature (378)..(378): n = any nucleotide
  misc_feature (411)..(411): n = any nucleotide
  misc_feature (440)..(440): n = any nucleotide
  misc_feature (484)..(484): n = any nucleotide
tttgatttcatatgctcatggttagaactgnaagtgagaanagccatgacggcgagctgagacgnaagcaataaacaaaatatagcagtaattaatcgagtaggaactgcatgaaggacatgaatncttttcatagtggtcggttngntgtctatagacgncgccaactcgagncagncctcaaagacnaantgtncattaaaagatagccagtgttatctttagtcctacgagagcttggatagatcacactgcgtgaaacatgtgtaagtaagtcgatctttcccngggttgtatatctcagctcacggacggaagaggctccttataatctcggcctgtgcgctgtccatgtccatggtcgncatcatctccganaggcggtcgctaaggtcgtcgacctcccggtgnaggctcttgatgtagttgcatgtcctctntcagtagcttcgcagatgaagctctgctcgtgccttcgccggcngggccctccggggagaa

SEQ ID NO: 4809 - DNA, 744 bp, Musa acuminata
  misc_feature (630)..(630): n = any nucleotide
attatagtggcctatcatgaagtggctctgtacagatacttaaagcatacatacacagaaacattatagtgtgtgaacccaccatatcggatcggtatacaatgtttcatctctatcaagtcaatcttcggtggcatatactaacagtcagaccttgttgatcctgtacaaggatgctggggaatgtggctgaaaataatcaaaatattcatggtctcctgctgtacataacaatctacatcggcaaccgaaaatctagcccagcgatgaagtggttggtccgcatcattgtgaaaacaaaatcatatagtaagattctcttgaatggcaaaaaatgacccacagattttgccaccaatgtctgggaatgtctcgtgtccaggaagaggtttcaccttgcctttcctattgacatccactggatactttagtaggtggccccttatttcagtaatctcattggccacgtattggctccagttaaactgaccgatgtcacaactcgcctcatgcattcaaggctctccggatggttaaaacattcctctatagttccaatgtgctctgcccacagcgacattctataaccaaaaatctgtccacgaggactagagagccttcttgcctgtntatgctgaggttggtacgcacccattgcaatctcagtgtccctggtaccttccaaggacctctggttgatgtttgctgatcccagtatcacatactcatcatccactatcatac

SEQ ID NO: 4810 - DNA, 567 bp, Musa acuminata
  misc_feature (2)..(2): n = any nucleotide
  misc_feature (11)..(11): n = any nucleotide
anctcaaagcnttaaaaagacttgaaagctctggaaaataaagatcattactagtaaattaaaaatgttgaaaatgagggacgttggtctcagttatattctctgctgtaactactttgtccagtgggctcttgcaatgtttctgcagttcaatatatctctgaatgtcaaaactatgcttctgaaatagtttcttttgtcttgacaagaacagcctcttcataaagtcttggtatgtcggatctctcgatgtaaaaaggaagtaggcatatccacaaagaatgccagctgtagtggcgaagaaggctattggctccatgacatcccatgagaactcccagaatgtaagccgaaagaagagaccaatctgaacgattaggaatcccaaccctaaccaaagtatgcgacggacttgcttgtgagcaagcatatcgatttcttgtttcttctcctgcagctgcttcaactcttctctccttgggtcattctcagggtgtcaaagaaagagggacagcccttcttataagatccacaaccttttccgggtggagatataccttatcccta

SEQ ID NO: 4811 - DNA, 442 bp, Musa acuminata
  misc_feature (26)..(26): n = any nucleotide
  misc_feature (136)..(136): n = any nucleotide
  misc_feature (140)..(140): n = any nucleotide
  misc_feature (178)..(178): n = any nucleotide
  misc_feature (187)..(187): n = any nucleotide
  misc_feature (194)..(194): n = any nucleotide
  misc_feature (198)..(198): n = any nucleotide
  misc_feature (204)..(204): n = any nucleotide
  misc_feature (429)..(429): n = any nucleotide
gtgtgtaatcggtctgttttcttcantgttaatttgccatggtatgcaaacaatagcttatacaaacattgcttacattttcaaaatcatacagcaccacaaatggagctgcggtgatcgaaaaacaacttaaaantacnttttcttcttgtgataaagcacataatggaaactcacntactcgttnttctacngttntttgcnatatggtggtaagcctaggttttctgtaccttcggagaagcaaagaagagcaaacgacgctgacagatgagaaggccatgcaagcgccggccaaccatggtggcatccttagccctgcgaggggaaagaggacaccagctgcgacaggtattgccacgatgttgtatgccattgcgaagaagtagttccaacgtatccgggcaaaggtcttcctcgagagatcgntagccgtaatcac

SEQ ID NO: 4812 - DNA, 647 bp, Musa acuminata
  misc_feature (93)..(117): n = any nucleotide
tttcatctatcagcatgagatctatagaaggaacaacaccatattatagacattaatgtgccttttccatccatgaacttctcagtttcatgnnnnnnnnnnnnnnnnnnnnnnnnnaagaaagcaagggtgaagcatccaacagtagtagtagtgtaccctctgatttaggttgaaactcctgcttaaaagggagccacattaagatacaggacactattattccggtggaacttcacttctgcagacaaaagatcacaaaggaaaatgaaggacaagaccagctgaacgccaacttcaaacaccataatgcaacaaattagtgcctgtacatcagcgatagacatcatccttgaagcaccttttgaggatctagttgcccactgcagtaactggaaggaacagcagaaagctctatccttcccttccattcctcaccaggcttcagaatgatgggcttctcaatggctgcagcttctacggatagcatatgcttgtaatcatcatctccaaaatctggcatggctttagccttcctgtcccaaggattccacaccacagcatctggaagtccatctttgcgcaaaacaaaagttcgtttcttttcatgatctataattgcatcttggttggtgtgctcaaatata

SEQ ID NO: 4813 - DNA, 538 bp, Musa acuminata
  misc_feature (13)..(13): n = any nucleotide
  misc_feature (17)..(17): n = any nucleotide
  misc_feature (21)..(21): n = any nucleotide
  misc_feature (27)..(27): n = any nucleotide
  misc_feature (30)..(30): n = any nucleotide
  misc_feature (47)..(48): n = any nucleotide
  misc_feature (56)..(56): n = any nucleotide
  misc_feature (65)..(65): n = any nucleotide
  misc_feature (79)..(79): n = any nucleotide
  misc_feature (96)..(96): n = any nucleotide
  misc_feature (123)..(123): n = any nucleotide
  misc_feature (130)..(130): n = any nucleotide
  misc_feature (136)..(136): n = any nucleotide
  misc_feature (150)..(150): n = any nucleotide
  misc_feature (168)..(168): n = any nucleotide
  misc_feature (195)..(195): n = any nucleotide
  misc_feature (290)..(290): n = any nucleotide
  misc_feature (366)..(366): n = any nucleotide
  misc_feature (429)..(429): n = any nucleotide
cttcggttaattncaanattnaatcantcnacaaactgatattaatnnaacagggncagattcgntggttacattaacnatgatgaaactagtaanattaccattgaattccgatccatatanatgaccnattttngttctttttgtctncaagtatcttatattctnctttgtgattggagtagcaagggaacntaccgacgatgctcaatccatagcctttcagtccaccatacttggcaggattgttagtcatcagtttcattgttcgaacacctaggtctcgtaanatctgtgcgcctatgccatattctcgtgaatctacaggcaatccgagctcctcattagcttccactgtgtcgcgcncgtcatcctgtaggttgtaagcacgaagcttgtgaccaagaccaatgccccttccttcatgtncacgaaggtaaaccaacacacctctgccagcattttcaatcatttccatagccaatgaaagttgactgccacagtcacatctagaagatccagatatgtcgccagtgag

SEQ ID NO: 4814 - DNA, 632 bp, Musa acuminata
  misc_feature (411)..(411): n = any nucleotide
atagtagaaggatgagaagagtgcggtagtgaagtctcaaggaaactttctccagtggggataaaaagaaaataaattccagagattgcaaatgctgcccacccgatatttgtgaaattgatataaattaaaatgtgtttcatggttcataattccatacagcagagcctcacatcggaagaatcaacgggttactctgtaggccttgacactttttaggaggtctttagccacgctgttgttcttgaaatgatcacgtacaggctgcaatataagatttagtgcttttgaaagagcaggcttcagatcagctggatgtaatactccactctcatagtccaatattagttcttccatgttgttgtatgtcttgtttccaccattttcctctttccgcacaacttcaaaatngccaaaccatggaaaaacaatgtatttaatgtactccaggcatgggttcccttccacaacctttggtgggcagtaagccttctttatcttcacattcacttcaccctcctcatcttccatgtaaatggaagaagatggatcactttttgacatcttctcctggccctcctgtaaaaccaggaagcatatgatgtgacaaaatgatggggcttatttttttt

SEQ ID NO: 4815 - DNA, 622 bp, Musa acuminata
  misc_feature (5)..(5): n = any nucleotide
  misc_feature (18)..(18): n = any nucleotide
  misc_feature (396)..(396): n = any nucleotide
  misc_feature (479)..(479): n = any nucleotide
  misc_feature (516)..(516): n = any nucleotide
  misc_feature (536)..(536): n = any nucleotide
  misc_feature (542)..(542): n = any nucleotide
  misc_feature (610)..(610): n = any nucleotide
ctcgnaactctccttttngataaagagttaatgataacaagatcaaatcaaaattattgcgccagttactcacatagtttgaatgattatggtgataaacgtgaataacactttacatggcataaagtacaaaattgaggtcaggatccagtctttcaattgaacgtgtaatagtttagtgtggtttggtacaaatccatcaacggcaaagtttcgggtggctgctggtagtgccaatcgaattccatcaagttcaggctttgcaactatttggcaaccaaggcgagacgtctcagttaggccaaaagcaaggtccagcatatcattttcttcatccgtcggatcttctaatttgttgtagtagttgacatccatcaccatcacatgacatgtggnacacgcaagagaaccctcacatgccccttcaagttcgatgtcattctcgtgagcggcttcaagcattgacattccaacagganccttgataaccttttcctcagcatccttatcaagggnagtcacagatatcgtttctntaatcntttccatccccctcagtagtttgaccattggctgcgttagaaaaacaaaattttcccatggggtatangaaaggggctaa

SEQ ID NO: 4816 - DNA, 550 bp, Musa acuminata
  misc_feature (2)..(2): n = any nucleotide
  misc_feature (5)..(5): n = any nucleotide
  misc_feature (17)..(17): n = any nucleotide
tngtnggcaccaccaantgtccatcaggtacaatgtgtgttctgcacaagactcaaaaggttaacccatacacagaaataattcaacatactggttacaagaaacagtacaagcccagttgcatatgtgataaatcagcatgacaataacaggcaacagtagaggccataaactcagccagccaaaagcagaaatcatcaccaaaaaccacaagaacaacctacatatcccaagaaataatgcagaagccagagctgttgagggctaaatgctcaattttttgattttgagtgcttcacaagccaatcgatgacagagtctatgttggttgagttcttgcatgagatcatgtaacaacaaacctctctgtctgtaatggatttcaggcccatttcatctgtcaaaccctgctttgtcagagcttctggcttatcaattttatttccaaggaccaacaatgggatcccattcagtgatggcttgcttagaagatcatgaagttcactttttgagatgggcaattatcacgggtctgctgcatcaacaacat

SEQ ID NO: 4817 - DNA, 641 bp, Musa acuminata
  misc_feature (10)..(10): n = any nucleotide
  misc_feature (404)..(404): n = any nucleotide
  misc_feature (428)..(428): n = any nucleotide
  misc_feature (517)..(517): n = any nucleotide
  misc_feature (535)..(535): n = any nucleotide
  misc_feature (537)..(537): n = any nucleotide
  misc_feature (544)..(544): n = any nucleotide
  misc_feature (582)..(582): n = any nucleotide
cctccccaantcctcacataaaaagagcaacttttttttctttatctactaaaagctgcttaaagtgatacatattctaaatgtcaagtaacaatgtgattgccaacataaacgacaaataaagaaataaggcgaaataaattaacgcaatatgttattttaagctcgcttcactgacactggtagtatacttgtatttgaggtaagcttttataaatgactcaagatccccgtccatcaccgatgagatgtctgatgtctcatacccggtccgcacatctttcacaagcttgtatggatggaagacataattgcgtatctgctgaccccactctgccttcactgcatctcctcttatttgtttgatttcggaagcacgctgctcctctgcaattacaagcagnttggctttcaaacggctcagggcnttgatcttgttagccaactgagtcctttcctctgtgcaacgaactgcaacaccagtaggaatgtgaacaattctaactgctgtttccantttgttgacattctgtcntncttttcntccagctctagaatagctaatttccaagtcttcttcangtatgtctaaatctagagattcttcaggaagaaggggcataacttcaacacaagcaaag

SEQ ID NO: 4818 - DNA, 412 bp, Musa acuminata
  misc_feature (371)..(371): n = any nucleotide
aacaatgtgtatatggtgggtgatctcgcataagtaatggatgcattgttaaaatagggcatgtgcgatctaattattatccctcccatgtatgaatgacgcattccgcttcctgtgggtgcttctttttccaaactgataaatacgtggtcatgccgaaaccgacgccactagcaaggtcttgaggacaacctcaaccaagttctgcacacctcccaggtagtgccctgtttccttcagctcatggtagtcgatccagctaaggcggctgcagatgtatcgctgtagagtaaccggcacgagcccgtcttcatccccatgccatagatgaactggaaagggcggttgcgagagatccatcggatcaaatncccacttcccgaacatcaccaccatgtctcggtaaaacgac

SEQ ID NO: 4819 - DNA, 631 bp, Musa acuminata
  misc_feature (599)..(599): n = any nucleotide
  misc_feature (620)..(620): n = any nucleotide
ataattttagaacaattcttctgcaaagtaacattacaataggagtgcaggatccaaatggtacagaaccaccaagcttggattattgagtgagatctcttcgagtacatgacaaagagcaaccaattcaaacagcaatggaggccatcagcatgatttgtcttgttcaagaagcagttgtcactgatgcatcttcagaattggtgcttcaagcagctgctgttgcatctttctcttcagttgtagaaggtatcggcttggtaggggcaggcaagcgaccgatgtcatcgaccctgtctcgctgcttcggtggaggcctcgctggtttcggtaataggcgtcccttctttgcgaaccactccggcgtgagcagtgccctaaaccccagcttgttgtagtacacctttctcacggaaccgccggcagcttccaccgcagcttttgcacgaactgtcactctcgatactcaaggtgtatcggccagttgatatgttcagaaccatgagccatcaacctgatgcatcctctatatgctttcctattgcactgtatccttaagggtttccatagtaataagtctgacgagtaattttcctgantatgagtttgcaatcttcccnaacctacaggc

SEQ ID NO: 4820 - DNA, 664 bp, Musa acuminata
ctatgtgcttatcaacattaatttctgcaaaacagtgaagaaaaaacattttaaatagtcacaatatcttttggtccacaaacggaattaaatgatgcaacattagaaccttatttcacccttttatgcttaagccattgtacaacattactagacagtgtagagacatattgcggatgagcatatcggcatttgatgacatccgaccccaaccacaagcaactgaaaggaacctgcaactcaagaagccttcttctgcttgctggcttgccatgccttgcgatccgtgtcgatcttcgagcggacgctggcatggaagccaggatatggctcgtatcccaacaaactaagtgcctcgagcagaacaaaaaatggagccatcaggaatgcttgagaaagattatcaagaagagctggtgctcgtttctcaaacattccatgacctataaattggaaactccagcaaaacaactgagctgccagaaccaccttccatgcgagggagaagccgaggcggacggcgagggcgtggctgccgaaccagcagaggaagcagaggatggcggcgagggagccggcttcctgtccatgaacaggtagaagagggcatagacgagagcgccgacgaaggcgaagttgaagggcagcgtcagggcgtcgctct

SEQ ID NO: 4821 - DNA, 555 bp, Musa acuminata
  misc_feature (13)..(13): n = any nucleotide
ttcaggttccaangcaaacaagattctgaaagcaaggaacaccaaagctaaaccaaagctcaaaacgaacacttcaacgaacacttcaaggccagcaacacaaaaggatcgataggagagagagacacagacagagcgagagaactgtggttgtagtcatgaaatggggggaagtcaatacccgaaccagccctccttgcatggcggcggcggtggccgagagccaaggttagcgtgaggtgcgttcttgacttcccacagatgatgtcctaatctccaccctcccccaacttcctctcctcctatccatgccgcgtgcttgctattctcagcgagccacttcgcctgcaactgaagccttgatccgttcgacggtgcaagcaatgaggctgttcaccgtcgcgaccgatccgagggagagcttggcagtggggacggagtcgaccaggatctggaacgccacagtcaacagggagccaccggagcctacttctccacccttctccgccgcgatggccgtcgggaagaatggcgaacctgacggaagagggcaac

SEQ ID NO: 4822 - DNA, 611 bp, Musa acuminata
  misc_feature (524)..(524): n = any nucleotide
atgtttacagttcgcatgccacgattccacactcccattacaagatattattggtatgagttcattaaacatggtgttctgcggcagtatctgtcagcttctcatgtagtcaagcagatatcatatgcatttttttactaagcagaagctttttttctcagaagatggtcaaaactgagtgtgttgatctttgcagcaagtataaaatcgttttcggtgagccctccagctgagtgagtccacaagtcaatttttacattattccaaccaaccagatgaaggtcaggatgatgaccttctgcctctgcagtattcgctacaagctgaaagaactccaatcctttggtaaaactcttcactttccatgatcgatgcaacttcaggatgcctccttcacataccaagccccatccttgcacctgaacaaggagttcattggctgattgttctgacatagctcgtatatcctttgagttgcatgggacacatttcttgccagctaaatcttggggtaagaacaagancaaaaaccatgggtaatctcctatttgatgacacgttaacatgggctgtatgcagcttgacaatccaacaatctgaacatccatgac

SEQ ID NO: 4823 - DNA, 532 bp, Musa acuminata
  misc_feature (281)..(316): n = any nucleotide
aaatcatctcattattcttaaatatacaagaaaatgctcagaaaacactatgatattacacatccaatatttgtttcaatttcaaaggacatacacaatcacatcttccttaaattgtctaaccttgactggagttcattgtctattccactatctccatttccagctgcttcaggttgggcaaccttgttagctgcctcaggtttggccacggcagttgaaggtgccttgacaagctctgcattgatatctactccaatttcatccaggacctgattcannnnnnnnnnnnnnnnnnnnnnnnnnnnnnnnnnnnccaaggcatcatctattgcatctcccattacctcacttaccatttccatcttctcattctgcagttcaaactcttgcattatcttctgcaatgctggtaggttcatctgcctgttcatctgtgccatagccttggtgacacctttcatggcctcacccattgcttgtgttgacttcagtgtctgaattctaagtgatacacccttgcagctgtgac

SEQ ID NO: 4824 - DNA, 1028 bp, Musa acuminata
  misc_feature (4)..(4): n = any nucleotide
  misc_feature (810)..(810): n = any nucleotide
  misc_feature (1000)..(1000): n = any nucleotide
tcancataagaaaattatggattagatttcaggtttcctgtccttttcatttgctttcagcgaatgctatgtatacaatcaaaactatgctgagtaagactgcactaccacataactggtaacctacaaagagcatacattgcagctctttctacaaaatccaagtgaatccttggatcctaccatatagagaggattctttgcacattctcctgctgcagcccactgtgggcaaagaacattctcatcttcacatgcgtcgcttgacctgtttttctctggtttgtcgaaagacctcacatgaatccattttgttgcagaccacttctcgccttctataacagggcagcttccatgcaagcttttaggatctgttgttgcatcaaggtggagactaaagaagagcaaggcgtcacctttttcaggttttactgcataaccattttttgcacaatctgaccaggtatcattcttcaactgagataacttaccctctgagttgggaaagatggtctccccacccttctgaacattggataagtacatcaatacggtggcaactcgatgaccgccaagttgttgattggtttggtcatgaaaataatcaaaatgtggctcatatttttccccaagttcatagtgcagtatttgcatggactcgccattctcttctggaaggaaggtccaagcagcaatcctcttctcaattcttgcaatgacttcatcctggcgcttctcaaggaacattccagagctcgtcctaacctcgctcatcacactcttacccaattcattatccgcaaccatggntttctccagcttatcctttgccagcgtcataaggtgatcgcattcgtcataggaaaggaaccgttgtacaggaaagccctggggcgccacgagagctgggtgacccgagtgggatcgaagaagtcggagtccgcttcggcccaacgacgatccaacaagaagaagggctgcgaagaaggggaagaggacnggtcgaagaagatcgtacgaacaacagt

SEQ ID NO: 4825 - DNA, 584 bp, Musa acuminata
cttcctccttccaccagcgtggacagcaagaacaagaaagattatttatactcgatgttacagtcaaatacatggggttaccgtaggaaactatagcggagtttcttgatttctatcttcgtgcaggcaaagccaggttagagagagaattggcgcatgagtatcaagtgttattcccaaagcccgaggaagaaagagtgggggtgggtcatgcatgcggtactgggtgcgaggagcagagtcttcccacgctagctaacatgttgccgaatggatgaagggattgaagaagcgaggagttggtggtgccgccgcgaattcttcggcaccgccgctgttgcagctgtcggcagagcctccaaccctgttgcaggaagggcacatggtgagggtggccgccggaagctgcatgtagagcggcggcgtgaacttgagggccttcagctcctgcagctccttccgcagcctccggttctcgacggtcagcgactcgcagcacctcttcaggagcttcgcggtcgacttccgtctgcttcagcttagtccttgctctcctgttctggaaccatacttccactgccgtg

SEQ ID NO: 4826 - DNA, 599 bp, Musa acuminata
cttcagattcactttcacgagagttcctcacaccggaagcacactcttattgtgacatattcgatactgcctcactgaccaaaccaaacccacatcgaatccccgagctcagatggagacgctgttggggattccccgtccggtgagcccgccgacgccggtcaagtcggagacgttggggtagagcagcgtgtagggcatcttaaccgggccggtgcgattcctcaggctcgcgtcctggttcatgcttatgatccgattctcgatctcgatcaacttatggctaaatcgctcgaacgcctcgagcgcgctgcggtccgtggtccactccggcgagtccctttgcccaaggtacacctcgtcggaggagtggcgcgacaggacctcgatgagtgacacgccgaggatggtctggaactggctggtgatggtcttcaggaacgctaggtccgggttcttctccagctcgtggtactccggcgtgcccggctcgggcatgaaccgccgactgatggtgggccggttggggaggtagccagcgtaggggtactgcccgaagttgaccgccgcgtgcagggcggaggcacccagatgatggt

SEQ ID NO: 4827 - DNA, 514 bp, Musa acuminata
  misc_feature (14)..(14): n = any nucleotide
  misc_feature (67)..(67): n = any nucleotide
  misc_feature (110)..(110): n = any nucleotide
  misc_feature (134)..(134): n = any nucleotide
  misc_feature (141)..(141): n = any nucleotide
  misc_feature (176)..(176): n = any nucleotide
  misc_feature (287)..(287): n = any nucleotide
  misc_feature (508)..(508): n = any nucleotide
agcttacttggatntgcttacttgctgtgggtgggattggtgtaattgggggacacaggcaagccancctctatcgccaactacggtggttcagatgctgaaggagaatnggtttcagaaggtgaagctgtttnatgctgnagaaggcacaatgagtgccctgaggaagagtgggntggaggtcatggttggcatcccaaatgacatgcttgcgatgctggccactagtatgaaggctgcaaacaactgggtgtccaataatgtctcagcatacatcaatgatggantcaatatcaggtatgtcgcagttggaaatgaacctttcttgcagacctacaatgggagctttctgcagactacttttccagcactccaaaatatccaaggagctctcatcaaagcaggcctcagtaaccaggtcaaagtcactactccacaaaatgctgatgtttatgcgtcacctagtggtcgaccttctgatggggacttccgctctgacattcgcganctcatg

SEQ ID NO: 4828 - DNA, 560 bp, Musa acuminata
tcattaaacaggaacagtagtagtcaagagaaagccaacatgagcttcaaatttccttacaagacaaaagagccgaacaaaaaacaaggaaatttaccacataacatggaagaacaccaaattgcacattctgctcaacagcatcaaatcctaagaggcatccctaatctatccaacctgcctgagccaggataagccttgttggtgaacttggcatgcagagacgacgacctctgagctgctactgcccccgaggatctcttcagtgatccagacttctcatactccggcctctgcttcggtgcgctatgcgacctcagtttcgccgtcgaagactgcgtgttcgccatgtagttggggaagtctgcgaacccactgaacaagctctgagagccctcgccattcgagggcgtgaaggggctttggttgcgctgccacgccgtgacgacgatgagtagtactgcgggcttccgcagaagcccactacctggagcgggaacccagggagctcagacattgctgctgcatgttgacggaggatggctgggaatggattgttg

SEQ ID NO: 4829 - DNA, 719 bp, Musa acuminata
  misc_feature (89)..(89): n = any nucleotide
  misc_feature (118)..(118): n = any nucleotide
acctcattggtagttctttttatgcttaatccacatgtataatgcttttgttacattccaacatagtacctaagtttgaagaagattanccagaaaacctgggtatatacagcatatnatatcagcaaacagaataaaaacaagttaaaaagctctttattcatcttacagcttctgcatatagtgcaatgttactggtcttggcacacgagataatagtcttttaaagcataaaatgggttttagaggtttgatagatgctgcaacataagtgcaataattttcagaaacacacacttgcggttggcgatgaacctcgaccagccaccttcagtggaagaggctcccagactctaccctcaccctcactgcagtgtccgcttgatttgacagctatagctgcctggtttatcgagttgcttgagctccctgctgctgcttctgccttgagccggagccgctcagcccttgaaccaatagtctgacctaaaattgaggctgctatggttagtgccatagctgtcttgggcatgaccacagacttcctgagcatgccaatgaatggcacagcagcatggactgcggcaaaccactgaggagagaacttttcagtatgttctcgccaaaccccaaggggaacgttgcagccatgcctagcaaagtattgctaacatttttgcaggcaggggtggggacggagggtcttcacaagggagtgc

SEQ ID NO: 4830 - DNA, 524 bp, Musa acuminata
  misc_feature (6)..(6): n = any nucleotide
  misc_feature (12)..(12): n = any nucleotide
cacaangcaacnccgatatgcattaaatagaagaccagtttcactgggataagttctgcagattccacataaaagaaaatgcaaaagacaaaaaagaaagcgagatttcaaatgtcttagcagatcaagcagcaaaggtagaagagcaaaagataactatttgccattgagatgatagatagctgcaaaatccaccaagactagagatctggggcagttgctgccgaacgcttgatagaagcagacttgatgagatggttgtagcttcccttttccttgaagagctgggagaaatggtgcttgcagtacaggatcccttcgagtgctgcatagttggagggggtaattgagcagccaccatgagaacatttgaaacaggacttgtgatatgcctgtccttccacagtgaccttttcaagaggataagctgtttttgcacaagtggcacatttttcttgtgttccagagaacatactggcggctttgctgggagacctagtcagttccggagctttttcagctga

SEQ ID NO: 4831 - DNA, 603 bp, Musa acuminata
  misc_feature (2)..(3): n = any nucleotide
  misc_feature (5)..(5): n = any nucleotide
  misc_feature (9)..(9): n = any nucleotide
  misc_feature (13)..(13): n = any nucleotide
  misc_feature (451)..(451): n = any nucleotide
  misc_feature (482)..(482): n = any nucleotide
  misc_feature (574)..(574): n = any nucleotide
  misc_feature (579)..(579): n = any nucleotide
anncnaaancgtnatatcttgattttatttcaagcacacatgtattatctacttcccacatatgccacaatgaacatctataagaacatcaatcaaagagaacatctgagcaaccaacataagtttcactccatacaaactatacaagaacacaaagacattgataaagtcccaggtccaattataaaaacatctgcagggttaatgtgcatcttgcacagcttcctgtagaattctcacggcactatcatagttaacaaaccccatgaaccagaactcatggttgtcaacggacacgacctgtatatatttttctcctgtatttgctctgcttgctgcgggattaactgatcttaactgatgaagaggaattgccaccttataatagctccattcagttttatctccaactttatatgagagaggattatcactacaaaatgcaagtttngcagtcgagagatacaagacgcccataacangaccagcagatgttgacaaatagcaagcatatgacttcttaagtttctcttcggaagaatctcgaaagtttgttgaaatatcttttcataanctccnttcaggctatgactttgggatgtc

SEQ ID NO: 4832 - DNA, 585 bp, Musa acuminata
  misc_feature (87)..(87): n = any nucleotide
  misc_feature (90)..(90): n = any nucleotide
  misc_feature (98)..(98): n = any nucleotide
  misc_feature (110)..(110): n = any nucleotide
  misc_feature (202)..(202): n = any nucleotide
  misc_feature (224)..(224): n = any nucleotide
  misc_feature (237)..(237): n = any nucleotide
  misc_feature (244)..(244): n = any nucleotide
  misc_feature (271)..(271): n = any nucleotide
  misc_feature (288)..(288): n = any nucleotide
  misc_feature (306)..(306): n = any nucleotide
  misc_feature (440)..(440): n = any nucleotide
  misc_feature (445)..(445): n = any nucleotide
  misc_feature (451)..(451): n = any nucleotide
  misc_feature (509)..(509): n = any nucleotide
  misc_feature (520)..(520): n = any nucleotide
  misc_feature (523)..(523): n = any nucleotide
  misc_feature (539)..(539): n = any nucleotide
  misc_feature (551)..(551): n = any nucleotide
ccatcagcatttatttagaagaacctgaattttttttttaatcgatgacaaggtcttcttcacaacaaaaaaagaatcaatgctggngtnctagtganagggatgctcantgcaagtcttccaatagatgttgcatcactgtcttgttgcttatgagcttcccctagtaattttggggtctatcaagaacatattctgagtnactttggttgcttaatttccgngttcctaaagcanttctgtnagtgagtaagcattgatcatagggaanaagtttgggaacggttnagtgtcatcagaagttanaatccgaaccctcctgggaatccaccacctggaaatccaccatcaaagtgaaaagtgaattgttgtccgccgccaaaagggttaaagcctccacctcccatccccgtaccctcatcaagatcctcgcctctgtnatatnttacangtttctcttcatcaccaagcacctcataggcagcagcaatttcctgaaacttggcctnagcttcctcanggntatcaacattcttatntggatgccactntaaagcaagcttcttgtatgcacgcttttatctc

SEQ ID NO: 4833 - DNA, 690 bp, Musa acuminata
  misc_feature (16)..(16): n = any nucleotide
  misc_feature (56)..(56): n = any nucleotide
cgatgacagattaatnagctataacttgcagatacataaagtgagatttgcatgtnttgcatgataacacttgggcaacctgttaaactagcagaaaatatcatccatcccatccatccaacttgtgagataaaactgtgataattccaagtattgaggttggtctataattacatccttttgatcttcgagaatgtccccgtctcagagaaataggtgctttgtattccactgccgagctgattcccatgagcttgtggatttgaaagttcgattccttgcacaggtgtaaatgctaaacttgatgtcaatcctgaagttgccccactgcttccatactgtttctccttgaaccttttggcaactttagcagcaagtttgctctgcgcaagtgatacacgcaactttccacttcctgcctgaccaagcataccatacccttcacccaagccatcacccaaggaactctcttctggaactccaaattgcatcctgttggccagcttcctcatatcagtcactgcatatctttctttcattttccgcagtcgacgaccacctctcttctttttgggctctgaatctggaactggaaaaggtttcggctgctttgcagggggtggctcttgccacttctcaatctttttacggatttcttctcgcaagtcccttccagtttttctgtaggat

SEQ ID NO: 4834 - DNA, 572 bp, Musa acuminata
  misc_feature (7)..(7): n = any nucleotide
  misc_feature (15)..(15): n = any nucleotide
  misc_feature (21)..(21): n = any nucleotide
  misc_feature (528)..(528): n = any nucleotide
  misc_feature (543)..(543): n = any nucleotide
  misc_feature (569)..(569): n = any nucleotide
accatgngatccaantgtacntttcttattaccaaagcttacagaacagttaatacacttcccagtgcactgtggctttcgccacattaggtaggtttaccggttgatggggatgactagggaatcatctacatatacattagcaacagtcacactaaattatttgtaccaatgaattgctgcacccctacaacgaacatctgcatgaacaaaaacaaccactaacaccaccaaatacataattctctactcctactgcccttctaaccccaacctacagctagaaacctgcaattgcttcaaacatgtaacaaagattgttttaaggtgggaagttggatgtcccctagcttggcacaccggtgtttttagtgcattaccatcccgaagatgatccagccaccatccagtttgataagtacatggcatctttcctaaatcagttcatgttctaggcgaacgtgcagcatcagaaccatatgcagaggagctttcactatctgaatcacttgatgatgatcctgaatnactactagagctgcntgaactactagatctacttgcatttnctc

SEQ ID NO: 4835 - DNA, 520 bp, Musa acuminata
  misc_feature (7)..(7): n = any nucleotide
catattntttgcagtgcatggtaaacacaaaacgtcggtaccaaattcatgtctgaaacagttaagaagacaatgagaactggtcccactcagacaagagacatgcagtaactccaatcacaccatgtccactagctgacacacacaagccatgagaagatgagcaactttgggtggaggtacacctagaaaccatggatcttgatgtgttctttcttcacaataccggcctgaactaaaaaggaagaaacattcttccgctgatcaccttggagctgaatcacctggcctagctctgggtcctggacaacggttccattacagcagaactctttcttaaggtccttcaggatcttgttgtagctgaactctttctttaatccctgcacagtggttagacacttcctgccattccgctgctgtacacggacgtgcacatactcctttgcaccaacacccgaatcgtcagcattcgcctcagcaaaaggatcaaaagcagtagggagcggcagtccagatc

SEQ ID NO: 4836 - DNA, 360 bp, Musa acuminata
  misc_feature (12)..(12): n = any nucleotide
  misc_feature (28)..(28): n = any nucleotide
  misc_feature (204)..(234): n = any nucleotide
gcgcgtcgaccntaaataaataataatnataatacaggacattcttagccatctaatatggtgaattgtggccaccatcctgcaacgtaggagacgacgtgcgctattcctcactcttcacagctcccccgcatcatcatcatctctctctccaatcactcttcaagatcaataggcacgaatccccaccagaattccttcttnnnnnnnnnnnnnnnnnnnnnnnnnnnnnnntgaaggtgtacgggccggccatgtcgacggccgtgtcgagagtcatggcttgcctcctagagaaggagatgcccttccaactcctccctatccacctccccaaagcccaacacaagtctcctgact

SEQ ID NO: 4837 - DNA, 662 bp, Musa acuminata
  misc_feature (8)..(8): n = any nucleotide
caaccacnaattaaacaagacatcataattgatgaataactaagatcagaacagcagaaaatgtcttgaaactgaactcaaccaaatacaaaatcatccttctgagacaactcagaaaatgtggattaggtgaccaagaacgtctatgatgaacagtagagtacggtagcaagacttgctgtttggcttatttcttcttcccagccttagcagcatctccagcctttgtcttcttaacaccacggactttcttcgccctgttcttcctttccttcatctgtttccttgatttctctacttttgttgcaagtccattcctaataagccgatacttgggctcatacttcttggcgttctctacggtgtcgtagatcaaaccgaatcccgtcgacttccctcctccaaagtgcgtccggaacttgaacacaaagatcgtgttggtatcgttcacctcatacagcttcgccaacttctccttcaattccgccttggagacatttgctctcccaggatgaagaacgtcgatgacgaattgcttcctggaaaggaggcgattggtcatgaatttccgggttcgaatagtaacagccttcgtatctgcattttctcctcctaatgcagcgagcaggagtaccgagtagcgagcggcgatgagcggaaga

SEQ ID NO: 4838 - DNA, 652 bp, Musa acuminata
  misc_feature (7)..(7): n = any nucleotide
  misc_feature (27)..(28): n = any nucleotide
  misc_feature (33)..(33): n = any nucleotide
  misc_feature (37)..(37): n = any nucleotide
  misc_feature (53)..(53): n = any nucleotide
  misc_feature (60)..(60): n = any nucleotide
  misc_feature (82)..(82): n = any nucleotide
  misc_feature (88)..(88): n = any nucleotide
  misc_feature (92)..(92): n = any nucleotide
  misc_feature (98)..(98): n = any nucleotide
atgtagntggcaggagtcatataccanncaatntaanactcaagcattaaaanctataangtgactcgaaaattttaggggnagaaanaaancagganaatgctatcttttgttgtggtataaagtcactgcctcttaattcgagatggaacggcagagtctatcctttcttttcaggtactcagggcagttgttttacagatgggacataaattctttatcatcaaccattgcttgatgcaagcagtgtggaagtcatggccacaatcgagtcggcccaactctgccccttccatgtattcttcccgacagatgcagcatggttcaacttcccccgatggttctgatgcaatagatacatacttccgttgtcgtaggcagttcaggagtttttcctcgctgagcccagtgttgacatttcctatacgctctcccaacaccaacagttcctcataagacatattatccacatccagccgcatatctctatacctgtcatgaaaattggtgcccccaacatatcctgactgctcaaatgataagaaatcctcaagcagcaaggtatccccccgacggatgagatcaaaaacattacgaatctctgacgtcctgcttctgcgttctcttgcagctgctagagtccgcatggaca

SEQ ID NO: 4839 - DNA, 559 bp, Musa acuminata
  misc_feature (216)..(216): n = any nucleotide
  misc_feature (416)..(416): n = any nucleotide
  misc_feature (457)..(457): n = any nucleotide
gttatctcatcatttttacaaaagcaaatttcaatgtgctgttctgaacaaaacaacaaaaacttagaaaaacaatgactttgatcgttcctccaaatatccggatgcatgtcatgccaccgagcagtttataattaccatcctgctgccttccaaatgaataaatatctcatccattccaacgaccaggaaaggtctagtactagaatctagggntctctcatttggaacttgaaaggtctagttcttatacttggctttactgttaggggggacgtccctgaggccaagctttgacagcacaaggcaataagaatcccagtctgtcctcctgagatacttgagaagtttctttcttctctggatcatctgctgtagtccctttctggagtgcttgtccttcttaggtaagactntgttgaggtgcttaattttggtggtaagttgtgccacttgnacaggcgcagagccacaatctgattcagacattttaaattcgtctcgaacccgcttgagctccagcttcatcttctctgccgatgacatgtgatctggatga

SEQ ID NO: 4840 - DNA, 479 bp, Musa acuminata
  misc_feature (6)..(6): n = any nucleotide
  misc_feature (448)..(448): n = any nucleotide
  misc_feature (465)..(465): n = any nucleotide
ttcacnagtacagctttcctcgtatcagcccaaagaaagcactttctcaggtattagccgttttctgcactgtcataagcattagatttgtgtttaggtgtaaaagtaaagcgttctggaacctttccaagcaacatctcagatatccgaatccagtcagcagctgaatcagaagccattagggtctcaaggtcatctcggccatagtagcctggggtggtctccaatttaaacgctgtggaactacatctaataggcccagtggaatatagcggtatgtataactcaaccattccaacaggaaatgcctcgttgtctccacacctttagtatcggagccccaatgctgtaggccagatcgaacaaaatctttgaggatattgaatcgctccccggaactaatatcccaatgtctttgttccttaatctcagtaaatatccaaggctngattagagccctcgagnaatcatgcacgtag

SEQ ID NO: 4841 - DNA, 624 bp, Musa acuminata
  misc_feature (578)..(578): n = any nucleotide
  misc_feature (585)..(585): n = any nucleotide
  misc_feature (616)..(616): n = any nucleotide
agcaaccgactgatagtcgaaataggaagagtatggtagatccaaaattcaattaccatttctttcagcttcattcaaacaaaataatctagtcatacaagtctcgaggatcaacaattacgaaaacctttattgacacaactttgccacaagtgatgcatccacagatccagtcctcaaatttgccggaacagaggcatttttcacaggttttagctctttcataccttagcatcctagacgctcaatggtttttggcgtctttgaacatcataatggacgtctattaaacctgttatgccagctgtgatcttttggccgatcttcactgggccgacgcctgaaggagtaccagttaaaatcacatccccttccacgagagtcataattgaactgatatggcttacaagaaacggaagtttgaagatcatgtctttggtcgaccctttctgcttaatttcatcatctaccttgagccataactcaagattgttagggtccaccaccattgatctgggaagaactgcactaattggagtgaaggtatcctgccctttggccactgtccaggggagacntgctganttggcagcagattggattctcttgctgtcanatccaaag

SEQ ID NO: 4842 - DNA, 587 bp, Musa acuminata
  misc_feature (41)..(41): n = any nucleotide
  misc_feature (44)..(44): n = any nucleotide
  misc_feature (47)..(47): n = any nucleotide
  misc_feature (57)..(57): n = any nucleotide
  misc_feature (140)..(140): n = any nucleotide
  misc_feature (252)..(252): n = any nucleotide
  misc_feature (315)..(315): n = any nucleotide
ggatgagaatgctcagaaacaggtagaaaatttggaaacgncanatnaggtccatgngatcaacggaactctcgctggaaggaacaggcaaagcaagttggaagaattgattctaagatattaggaatcttaaccaagtngttgtttgggacttgttaaagaataaacgccttcggtatttgacctggaaccacttcatggcattcatccttggtaaccctatggctggattccaacgcgtgacttgcatcngcggcgacgggccacacgataaccagcacgttccaagaccacatagaaatccatgccataganacctgtggacgggtcatacttgattccaagatcaatgtgttcttgtatgccgaaaccaaaacaaccagtgtcactgaagtttcttctcagaagctcatattccttcactttcagtccactctccaggagctgcatcgccttgtcacccctgacggtgacattagcacgcaatcttttcgttgcgctgatcccaaatgacctaacagtgtatcgtgccttcgagaacaccggtgtttgcccgctcattgctctaacaccttgggcggcctagt

SEQ ID NO: 4843 - DNA, 595 bp, Musa acuminata
  misc_feature (561)..(561): n = any nucleotide
  misc_feature (584)..(584): n = any nucleotide
aacttcaaaataatctgactttatgacctgtgcttgtacatcagaatgtgacagagagatcatctacagacaagcaattattttgacatctcgctcggtccacgagttgtggacacagcaggtcacattaagcctgcagaaacccattgttgtcgaggaacgaaatgatttgctcagccatagcttttggagtaggacacttgccatcgttctgttgtattactatctcacaatccaagggtgattcatatggatcgtctaccccggtaaagccttttatttttcctgctcgtgcaagcttgtataaaccttttggatctcttgcctcacagacctccaaaggtatattaagaaaaacctcaataaatgaagaatctgatagcattgcacggcaggcatctctttccttcctatatggagagattaaactagctatacaaatgagaccagcatccgcaaatagttttgctacttctccaactctgcgtatgttttcggcacgtcttctccgttgaaactaagatctcgattcagaccatgtctaacattgtcacatcaagntgtaagtagatgactctgtaggnaactctcgact

SEQ ID NO: 4844 - DNA, 440 bp, Musa acuminata
  misc_feature (6)..(7): n = any nucleotide
  misc_feature (14)..(14): n = any nucleotide
aaaaannccatggnaagaaagattttttttcttcatgattctgctgatggaatagatatctcagttcttgaatcgtttccggacagtcagaaatgatgaaggaatcattcatttctcgctacttcacacctgttctaaatctttttctctcgtgtatgttgtaacatttcatcctatcaacactggaatttctgtacaagacttttctaatggttcccgaaaacttttcctatacgaccatgttttggctaccaacattatcttgtctcttctctagaagttctccttgtggaaatggaatcgagtgctggtgtcatggctgaattcttgtgaaagatccttcagtgattttgtgagtgtgggaggtccacagtagaaaacaccaattcgagcagctttatgggtgttggacaagtcggtaaacactttcctccagtttg

SEQ ID NO: 4845 - DNA, 603 bp, Musa acuminata
gagccacgttgagattgactgattcataatattagtattacatggggttgagatttgatgtttctttacaacaggagagcatcaacacagcaggaagaagaaagacaatccaagctttggtgttctacaggactaggccagaagccagaagttcttctgccatctggtgctcacaaggaatccacccactccactgctctgtttcctcactgccatggtcaagcactcggctctgctgatgcactgctccaccaagtcctcatggctgctctggaacatgcagcacagtgaggatggtttggactgcttcagcaccagaacagaggcatcaagcttcttgacttggcccagaacggtggccagtttgggtccttggataaccaatgcttccactcgtacctggggtcgcatcgccttgcacatggaaccaagggagttgacgagttgggaagtctcctcctccctgtgagcagaggcggagcaatggggagggaggacatggaggagggtcatgacgtcccccttgttcgccacatgagtcaacgcccacatcatggcatgcttggcgcgagcggtgcggtctatcaccaccatcaccctctt

SEQ ID NO: 4846 - DNA, 590 bp, Musa acuminata
  misc_feature (2)..(2): n = any nucleotide
cnactttttatctatgaacaagatcatcagggacctcagttccccaagcggcaagctgcttttcttcatgctgtacaggcttatcttctgcagcttctttacgagccatatttgccttcaaaagctctgttgcagcttcagcagcttcaattcctgctgagcctgtgcagtagctattgcggatggtttgtttacagcatttgtagccccaatggtgatccctccaccatgatccccaaactgtggtgtggttattgatatagacatcttcttcatatttgcttctgggaagggaggtctcctggcctcttattattcgaccagcacgatcatactcaacctctctctcactttgtccaagaagaagttctctaggtaatgcttcttcagatgctgcatttccatatttctccatgatggtatcctttgtgttgtttttcaacttgtccttgataaccttataattcttaaagagtagttctgcttgagaaggggcagcttgcatgtggatatctgtcccttctcaaaagcttcccaggcatggatgttaagctgtttaaactccagtgcttggtccggctaagtctgtt

SEQ ID NO: 4847 - DNA, 587 bp, Musa acuminata
ttggatatattcaaatatgtcgtttgaatttgatcatacattgcaattcttggggcaccaatgctctcaaaaaatcggtatggaattcaaaactattacaataactgtatgaatgatagttacaaaaaaaagaatatgaacctcaccgactacctcattatccaatcttcaaagcctccctaaaaccaataccgaaacttgcatgcactcctttcttgccaaaaccagtgttccctttttgcatcatagctacaaattcattgtaatctatgcgtccgtcattatcttgatccacgtctctgatcatatcctccaggcgcacatcttctatgccaaactcctgacaagcctgctgcagttcgtcttgagttatgtaaccactcccatctttgtcgaagtatgagaaagccgcaaatagatgatcctctctctctatcttgtttagatgcaaagtggcagcaataaactcgccataatcaatggttccgctgttatcaacatcgcctgcataagagcataaatttctgactccttgagattagcaccaaacttttccaatccagccttcattcttcataggtatctgt

SEQ ID NO: 4848 - DNA, 564 bp, Musa acuminata
  misc_feature (489)..(489): n = any nucleotide
  misc_feature (563)..(563): n = any nucleotide
agattatactgcagcacagagactaagagcggtacatctgatcacggagaggagggaggagggagctgcatggatagtggaggtacagtagattgcaccagagacagtagacaacagagacggagcggtggacgcatgcacgatggctctctatcgccgcctggcagcggtctcccgctgagaattgaagtagacggcggcgacggggaggtcgagggccgttctcctcggcgaaacggcgcgtgctgaagcggtccctcgaggccggcgggctgacggcttgccgtcgcttctgcttgaagagcacgaagacgaacctgtggatgccaatgttcggccgggggctctcgtagctcaccacctcccttccaaaagaagcatctgttgtgcctggaatgtcggtcacaatccaatgcaggtgctccctgagatatggatcgcttggcccctgggacgtctggatctgtcataaccagtgtgaagaaggancctcatgtcaccaacctgcacctcgactctgggccttgatgtgactgtagaagggtagaactcatggccattgna

SEQ ID NO: 4849 - DNA, 388 bp, Musa acuminata
  misc_feature (119)..(119): n = any nucleotide
  misc_feature (286)..(286): n = any nucleotide
  misc_feature (337)..(337): n = any nucleotide
ggtgaaaagatacatgctgtgcacttctggcaacgtaaaactcagatatcacagaagatacaaggaagatcactgcttcatgaggttaacaacatgcacaggtagtgttagtgatccantaagaaaacggcgctgtcccagatgctaatgctttctgttgtgctctttgatctttttgtgtttcttggagttggtccatgatgatggtagactattctgggaagttcacatgttcttctgagctgctagaccatagggggtttgtagtcaagcatttctcttatgnttaaccgaattgaaggtcccattgatgaacaaatatgtgcacttttccagnatactccttttgcaccagaaggtttgtttgcttctatcgatctaactgctg

SEQ ID NO: 4850 - DNA, 688 bp, Musa acuminata
  misc_feature (14)..(14): n = any nucleotide
  misc_feature (655)..(655): n = any nucleotide
tagaacttgaatantatggtaaacacaccaaaagaaggaagaacatgaataatagaaccttcatgaataatagaaccttgaataagaacatggtaaacacaccacaagcctgaagaggtcatattacaagaagtaggagaaaaaacccacaaggaaaccaaagagataaacatccaatgcagcttcttctcatgaggtacctcagatcgtttgttcgatatcagggaagccatttgaggtactttttgagttttatttaggaggcagacttagataaatctttggtggatctgttgtatttcatgtgactcttcacgagctgtccagctgcaagagccgagaggagggagagctccccggctagaacagcgcctgccacgacggacgccaggcgtctcgcgtttgccccaggagtgtccaagcttgcacccttcacaccaagtaggtccaagcaggcagactgggaggccagctgagtcccaccaccaactgtgccaacctcaatggatggcatggtcacagagacgtgaagatcctttccatcattgacagcttccatcatggtgatacaatgagaactctccacattctgagctggatcttggccggtggctatgtagatggcagacactatgttgctggcatgagcattgancctccaagagatccagcaaccgcagagccagca

SEQ ID NO: 4851 - DNA, 564 bp, Musa acuminata
  misc_feature (502)..(502): n = any nucleotide
  misc_feature (514)..(514): n = any nucleotide
  misc_feature (521)..(521): n = any nucleotide
  misc_feature (546)..(546): n = any nucleotide
agaagtttatgactttcaacttcttgcttggtttaattggtgcgatcacacattattctgatcatcgataacatatcgttgtttaaggttacaggcaaaagggagaacgagattatatatcagaaacaactgatgagaggaacatatccagacttgtgattgagtttccatttcaacatgcagcactcagaaaatgaagaccacactgtcatggattctggacttctgattctgtgccacacattcagagatccacatcaggttccgtatctcctgctccctcagtctcatataagcaaagaagacagcatagtgaaactgctgttcaaaagccaagcagagtctcttcacttcctcttcataaaatgctttgtccagcatctgggctttctccataagatatcttggcaaaaattgactgatatggtggatatttctccatcacagcacggacctggtcaatatcctcgctgatagcaagttcttcatgaccataaggatntaacaaggccanagtttgnataaagcttccgacgatcatctctngtcattcagtgcccatgc

SEQ ID NO: 4852 - DNA, 633 bp, Musa acuminata
  misc_feature (602)..(602): n = any nucleotide
cacatgacattcatgttcaagaaaaaggcactgtcttgtccctgggatgtcctaatatgacctcagatgatgtggttcggtaaacttaaataccaacatgatagaataacatttttgggctcatgcaagatttgacatcaaaatcttaaagaaaaatctcatagttatgatgagatgatggtttgttctagatctcatcgaggaactccaaaagatcgtcgacctcttgcctcaaggccgctaatttctgctgctgtgatgcaacgcggttctctatttctcgcccaccaagtttcttctcaaaacaatcaaccaccgtggaatgtctcattaacatcttctcttgcatatctttctcctttgcaaccagctcctctacctttggccatatatgggaagcctgaggagaatggtgaagaaacgtcaccaatggcttcaactccttgaccaattctttgagttgtgcatcagctgtcttacgagctattttacatgattggacatctcctgtcctcgagagatctcgtagggaagcatccagcttgtcatggactgctaaacattgattgatgatattctggatctgctgaactgttgcttgnactcctctaattgaatttttgcaagatacga

SEQ ID NO: 4853 - DNA, 434 bp, Musa acuminata
  misc_feature (12)..(12): n = any nucleotide
  misc_feature (300)..(300): n = any nucleotide
  misc_feature (368)..(368): n = any nucleotide
  misc_feature (388)..(388): n = any nucleotide
  misc_feature (390)..(390): n = any nucleotide
tgcatcacctgngcccagcggtgatacccccaatagcaaacataacctggctaaaaaatgttgcaactgactgttcattagcagttggaggaaggccaccaacatatacacgccgagcatgccgagtagcatggttgagtcatggcttgcactggcatgatagggatagttggaatctgtccagctgccaaagaaaacatgttcggaaacattccaggaatggctggagtggctccaggaagttgacctgtatagagaaactgagtagctgacatgtaatactaaaacaattataataancatcagagaatatatgcagcatcattcttttatgccctcgcacgtacgagatttgatctggattctgnaatagaattcatcacaaagnanacaaataaactaatcactttcatggattaaagataatatatgta

SEQ ID NO: 4854 - DNA, 551 bp, Musa acuminata
gttcatcaagctgcgagtgtagaacaaatttttagggtctcaaagatctgatatcctgtatcagcttctcgaatgccgtgaaggatgagccgccggtggaggagacgctgtctcttgccatctccgccatcttagcggcggatgtcctcaactcttctgccttgtttccctccatcatctccctcaccatcttctccacgatgtccctgccgtgcatgtccttcatgtccaatcctaccctccacacctcccccacgaacctgctgttggtctgctggtccgcaaagaatggccagcacagcatgggaacgccggccaccaggctctccagcgtcgagttccatccgctgtgcgtcaggaagcaccccaccgctgggtggcccagtacctcctcctgcggtacccactccaccaggtaccccctctccctcgtcgctttttccagctgcgctgctatcgctccggcggcggcggctccctcgcccaactcttttccgtcgaccaggtcccgcctcaccacccacaggaaccgttgcccgctgttgaccagc

SEQ ID NO: 4855 - DNA, 446 bp, Musa acuminata
  misc_feature (13)..(13): n = any nucleotide
  misc_feature (152)..(152): n = any nucleotide
  misc_feature (232)..(232): n = any nucleotide
  misc_feature (243)..(243): n = any nucleotide
  misc_feature (269)..(269): n = any nucleotide
  misc_feature (335)..(336): n = any nucleotide
  misc_feature (371)..(371): n = any nucleotide
cctggtaaatatnttctctctaactcctaggatagaaggatatctgccaccatcatgctttttcaaaaattcttgcagcaagtttctcattttaaaggcctcttccatgtagttatcctggttcatatctatagtttgtagaccttcaccangtgtgaagataatagcatggttttggttttctggcttcccttcacccagaattgcagggcctggaagttttattcgatanatctcctggtnaagattttgtacttgctcggatggancatcagtcttagacaaggaagccttcaccagaacagaatagtagtctttataggttttcctacttnnagtagtactagttacctcaacctcatcaatataanccacacgaagagatggatacactctcatgagttttaaaatatcttgtgcacgttggtgaccagatcttttgtcaa

SEQ ID NO: 4856 - DNA, 558 bp, Musa acuminata
  misc_feature (512)..(512): n = any nucleotide
cattggttagattggttgattgacatatctaagaaattggttcacactcccaaataagtagttgaattgccgtccaacttcttactttatagatatagcatcaaggcaggaaccttttaggaaccaagttaagaatgtaacatacggataggtttgtttattatgcttatactagcggatccttggggacggcaataaggcgaagagggatcttctttggagtgacgagtccaggagcttccgacatgtccaaatccaccgggttcaagccgtcaggtaattcccagttgaagtgatacaggaggttggccagagcaatctcgatggtggccatggcgaagttgattccagggcacatccttcgtccagctccaaatgggatgaacaggaagtcattgcctctgtagtccacggcgttgtccatgaacctctcgggtttgaactcctctggtgcttcccaggacttgggatctctcgctatggcccaggcgttgacgataacccttgttttngccgggacatggtaaccctgcaacgagaagctgctcatggtctctc

SEQ ID NO: 4857 - DNA, 528 bp, Musa acuminata
  misc_feature (105)..(105): n = any nucleotide
  misc_feature (117)..(117): n = any nucleotide
  misc_feature (515)..(515): n = any nucleotide
cctttacctgctgaagtgacaactaggaaatacatgggagaacaacaaaggatatacatgatagcaatttataacagatactacgatctcttgctttttttcttntctcctgttgtnttgccacaataggcaattcaaaagaatttgatctatgacgtgcaaactttcacccaaaaccttcaagttgctttagaatagaagggaagcctgcattcatctggactgaagccgactctgtacggttgaccactaaaaaccattttcaggagacgacatgctgtatgtggtgtcgatcatcattatttgattacagatggcacaagtatcacttctctccatccattcaagaatgcaagacagatgaaaatggtgttcacactttgtcataattcgagggttctctgtgtcataatcttcgagacaaatggggcaagcgtcctcctcatctgtagttgaggtaacaggcttacttatctcatcttcagtagtcttaggagaattatgctcgctctgantttattcttgcgt

SEQ ID NO: 4858 - DNA, 759 bp, Musa acuminata
  misc_feature (94)..(94): n = any nucleotide
  misc_feature (146)..(146): n = any nucleotide
tatattctcatattctctaggtaacgaaattcaagcaactcactgctgctctaaagaacactgcacaaacaccatacagagagacatgtgcaanaaaatgagacagctgcactaaacaaggatcacacatgatacttttgggaaanagaagatacccatgtcacatgagaaaatcacaagaatggtcagcctagcaaattcagcttcgtggaggaacttgatatgattcttacaaaaagccaacgagcaaaagtgaattcaaaagtccagcctaacttgcagatggctcagctaatagaccagatctgttaccttcaggttgcacaccagaatgtaactgctccatctcctgaccagggaacacttcagactgcaaagatggagcaatgttgtttacatgaagccacgtcaactcccacaaactatcaccacctattgtgcttcttttcgcaagaataccttttgatttcatcatcaaaagagtgttcttgaggagttcaggaatcagttcttgcagtttatcgctcttcttacctctcactttcaccttcatatacttctccaaacgactgagtacccccagccacagcttgcagaaactactcagcccaaaaagatcttgccattgctgcaaaaacacctttgacagtaacttcatgggcatgcaaaagtgtgccctccatgttccggtaatctttctgggaatgattctgtgcaatctccagcaagtcatcaagcatagtaatataactagatcga

SEQ ID NO: 4859 - DNA, 585 bp, Musa acuminata
  misc_feature (6)..(9): n = any nucleotide
  misc_feature (11)..(11): n = any nucleotide
  misc_feature (15)..(15): n = any nucleotide
  misc_feature (552)..(552): n = any nucleotide
tatttnnnnangagnttctaccttcacttctgcaaggggtaacccagcagaagcagtatgaatggtgcacataagataactcacccatctaaaacaactaggaaatgttctactcatccatagctcttgataattccaaatcaattcctactgtcagttcctgacctgtatcggttttctcttctactttggtgttaatatttctcttggcatcatttgcctcatctgcgcttgatgacgcagctgctacacactcctggaaccggaagcagctgatgaggtggtcattcgtcagtccggaagactgcatgaaggagtatatgactgtcggacccacgctgcgaaaaccccttttaacgaggtctttgctgatgacatctgcttttggggtcttcacgggaacctgacgtggatagcgaaatttgctgacaatgggtttgtagttcacaaagctccagcagtatttatcgaatgatccaaactcatctgttatcttgagtatctgggcgtgcatttctcaatgatggctcggagctttggctctgacaaaanggagctagaagtgcttccaggcacttaaaatct

SEQ ID NO: 4860 - DNA, 544 bp, Musa acuminata
  misc_feature (4)..(4): n = any nucleotide
  misc_feature (21)..(21): n = any nucleotide
  misc_feature (115)..(143): n = any nucleotide
  misc_feature (222)..(222): n = any nucleotide
  misc_feature (447)..(447): n = any nucleotide
  misc_feature (481)..(481): n = any nucleotide
aagncatattccatggttgancacatcatgcatctccacaaccatactttgactgaaaccttcagtatgttgcatgccttgctcatacactgatacatccatgagctactggtannnnnnnnnnnnnnnnnnnnnnnnnnnnngctcgctcgctcttacacaagaggtccacccttgaggtattcagtgaaagccagtgccaccaagccgagcatggcgaanggccgttccagagctctgcatcggctgtcatcacgccactagacttggactgcacgctcacgcccttgaacaggggcaccaaggaggcagcagaaagcaaggcggcggtgcccgcgaaccacggcagcccgccattcgcgagctgagccaccaggtcgtcgcccctcgtgagctccaccgcgatggctgacacgaacccgatcatcgccaatcttccgttgatcntctccggtgccggcccactgaacgctaggatatncgagaagtcgtgtttccttgcgcttgggtgtcggtggaggagtctgcactggctgcggcggcg

SEQ ID NO: 4861 - DNA, 748 bp, Musa acuminata
  misc_feature (61)..(61): n = any nucleotide
  misc_feature (525)..(525): n = any nucleotide
  misc_feature (527)..(527): n = any nucleotide
  misc_feature (529)..(529): n = any nucleotide
  misc_feature (562)..(562): n = any nucleotide
  misc_feature (573)..(573): n = any nucleotide
  misc_feature (583)..(583): n = any nucleotide
  misc_feature (668)..(668): n = any nucleotide
  misc_feature (673)..(673): n = any nucleotide
  misc_feature (695)..(695): n = any nucleotide
  misc_feature (699)..(699): n = any nucleotide
taaatcttcttatgtggttgggttgacatttcattcaccaagaatggagtgcttgaaaganactctaaaagcgttaatctcatcgtatcatcgagattcccagattgagttctagtggacgcaagctaaagaggcagacggtgaaagttcgcatctaccaaatccttactctgagatttctgtttcccagaacaatacgaattctgaatcaccacagaagaatcgatcaacatgcgacgtaaatgagtatcaaccataataacagatgacttttcctccatggagatcgatgcagcctcagtggccatgttcaagaagccagggttgttcttgagcaactgtcaacggcacaaccgagaacatcacggtaatcccgggagatgatgaagtgatcgtagacccttccatcgctgctccttttgtactcgagtagcagcatcgaatggttgaaggctgtgagctttacgaacccgtagtcatggtcttgatagtaactccatctcgctcggaccgtggtgaagtcancnangctggcacctccacctccgacaactacatgtgnggttgcttcgnaggggccacngtaatagttcgatcccgttccgtatgcaggtgttctgatagacccgggcatgttctttcatagttgtgtacatgtcccaaaaagngcatntcaccttgtacttctggcaganttcntgaaggctttctcttcccataggctcctcagatgttccttcatcaccat

SEQ ID NO: 4862 - DNA, 382 bp, Musa acuminata
  misc_feature (10)..(10): n = any nucleotide
ctttaagcantgaattccttttcctccaagttcctatccaaagatcagtttgataccttttgtagttgacttgtcatacatatccttccggatgtcatcattctcttcattgtcatctgcttcctgtccaccattttctacatcactttcactagccgtttcccactcagaatcatcagcttctgggccatagacatctccagatccatcctcggtaggaatgcccccatgcttaatagctgcttctctgaataaccatgcagcatgcatctgcttcttcactaacctttcagcataatcaggaactttgttgtgccttaaagaaaggtcaggatcattagactgagagcactcattaatgaaaagaatggcatctaacaag

SEQ ID NO: 4863 - DNA, 485 bp, Musa acuminata
ttcatttacaagtttaccaacctttggcatatctacaggtctgccatttacataaaaatattgcctatctcctaaattacgaccactaccatatcgagacttagaaagaaagccttcaactttgcaaccctctgatacacataaattcagtggctctaagcactgcaaggtacttagaccaaatacagttatgatattatctttcaatgaactgcttccttgagttttcagtaccatggacttcgaattttttccagttgtatttgtgcaaagcaatcgaacacccttagcgattagggcatatgcattcaataaagaaacaagctttccgtattctcgtcgtatattccgactgaattccttacttcgcactggcaaagtggagaataacttctcaacggtcacagtggttccaacctgtcgtgcaatcttcttttcagtgtcactaaaccataatgatcaaagattaaatgtgtaccaagtgg

SEQ ID NO: 4864 - DNA, 587 bp, Musa acuminata
aattttaatgttgacaatttgcaatcatatatagtttataatcagatcagggtctcaacgtaggcctgacgtctcctcataatgttatcgtagaccacaagtagggtacaagatccattcgacaattctcacccctcaacttccaacatgggaaagagatgttccaatctcctccgtgctccacaagtggttgatgcaaaaaaaagtgaccaccatctttgacttgggtgtgtcctttaccataatctacaagcagccataagtagcttcagaaaccattagtcatcatgatcctcttctggcttatcttccttttgcttttgctgaggctctgactccccttgcagagatgccagcaaatctttcagcgaggggtcattaggatcaacacctgggagcgaatttaggatagaagaaacaaatgactggtcctccaacaccttactcatctcagattgagagacatgtctcttgcactgtcctgaacagacatttgaagggcatatgctaactcttgatcatctacagtagcatctgacatatctgtgtcaaccacaggtgcagtgccagactcagcaacatccatg

SEQ ID NO: 4865 - DNA, 576 bp, Musa acuminata
attagataatggatgagaaaaagttggatttttacaagtagtgttatctcaatgaggagacggcaaagaaagagcttccgatcccgactatttgtattgattataacaaacacaaggaaggataatatagaagaaacaaagaggagaaaaaaaatcaagaaaattacatcagtacattcttaaccaagcttcagagcctccctaaaaccaatgctgaagttactttgtaatccctttttgccaatgacagtagtatttcctttttgcatcattgccacgaattcgttgtaatctatgcgaccatcattatcttgatctgcttctctgatcatttcctctagccggacatcccccataccaaattcttcgcaagcctgttgcaactcgtccgcagttatataaccgcttccatctttatcaaaatattggaaggctgcaaataagtggtcctccttctctatcttgtttagatgtaatgtagcagcaataaactcatcataatctatagtaccactgttatcaacatctgctgcttgcataagtgcataaatttctgattccttaagttcggacgcg

SEQ ID NO: 4866 - DNA, 563 bp, Musa acuminata
  misc_feature (2)..(4): n = any nucleotide
  misc_feature (6)..(6): n = any nucleotide
  misc_feature (14)..(14): n = any nucleotide
  misc_feature (18)..(18): n = any nucleotide
  misc_feature (20)..(20): n = any nucleotide
  misc_feature (36)..(37): n = any nucleotide
  misc_feature (43)..(44): n = any nucleotide
  misc_feature (50)..(50): n = any nucleotide
  misc_feature (71)..(71): n = any nucleotide
  misc_feature (74)..(74): n = any nucleotide
  misc_feature (79)..(80): n = any nucleotide
  misc_feature (133)..(133): n = any nucleotide
  misc_feature (213)..(213): n = any nucleotide
  misc_feature (343)..(343): n = any nucleotide
  misc_feature (416)..(416): n = any nucleotide
  misc_feature (423)..(423): n = any nucleotide
  misc_feature (430)..(430): n = any nucleotide
  misc_feature (457)..(457): n = any nucleotide
  misc_feature (464)..(464): n = any nucleotide
  misc_feature (475)..(475): n = any nucleotide
  misc_feature (499)..(499): n = any nucleotide
  misc_feature (510)..(510): n = any nucleotide
  misc_feature (517)..(518): n = any nucleotide
  misc_feature (529)..(529): n = any nucleotide
  misc_feature (534)..(534): n = any nucleotide
  misc_feature (548)..(548): n = any nucleotide
annnantctgatantacntncatggataattacagnnaacaannatcctntggtttatttatctaaacctncanttgannaggttgttgttttggtaaaaagagccactcctaattaaattgaaatggcagancaatttagctgcctcattttcaacacccatttcttcgagaatgtaaatccacatgtggagttcaatattggcatccatgntattgtgacaaatacttagatattgcatctaatgactcattattttcttctgtgaaaccaatagaaaccttctgagagcaagcatggaaatccacgtatactttgagatcttctcctttatcatcagcantaaggcagagctcaaaacagttttcagaatctgagcctgcagacctttgaatatgccaggaaacccttctttnccccatntagaagntaaggcacccaccattgtcttgggggntttagantgtgtatcctngttggattcatcttcagtatcagnagattgaatcntaacttnncacctaatagntgggnaggtcacgatggtngctacgctctttgag

SEQ ID NO: 4867 - DNA, 413 bp, Musa acuminata
  misc_feature (135)..(135): n = any nucleotide
cctacatgtccattgataattattcttgggatgaaaataaatagtattctgaagtagccatcgctcacactatgatatcaggagctaattttccttgcttttggcgtctttgagctgccccctcttgcggatgtncatgcagaagcccaagcgccagtggtcgataaccgactctggtatggctgagagcagacaccaaatgagggaatggggccagtagggtgtgcatcttggttcatagcctatacaccgcaaagctgcacgggcataggtgtctggtgatggaacaaagaaggaagatctcctgatcgatgccatctttgtcgccacatataagggcacctggcattgcacatctattcccttgcccttatactcaacatacagacatctcgagaattgatcaatgtacg

SEQ ID NO: 4868 - DNA, 277 bp, Musa acuminata
  misc_feature (13)..(13): n = any nucleotide
  misc_feature (25)..(25): n = any nucleotide
  misc_feature (34)..(34): n = any nucleotide
  misc_feature (36)..(36): n = any nucleotide
  misc_feature (40)..(40): n = any nucleotide
  misc_feature (66)..(66): n = any nucleotide
  misc_feature (68)..(68): n = any nucleotide
  misc_feature (73)..(73): n = any nucleotide
  misc_feature (75)..(75): n = any nucleotide
  misc_feature (87)..(87): n = any nucleotide
  misc_feature (107)..(108): n = any nucleotide
  misc_feature (112)..(112): n = any nucleotide
  misc_feature (184)..(184): n = any nucleotide
  misc_feature (225)..(225): n = any nucleotide
  misc_feature (228)..(228): n = any nucleotide
  misc_feature (231)..(231): n = any nucleotide
  misc_feature (238)..(239): n = any nucleotide
  misc_feature (261)..(261): n = any nucleotide
ccttcatactttnttgcacaaacanattatacanangttngcagtcatttgtatccattactgcanantctananactccaggccanagcatcctcccatcatccanngtgncatattttgtgtctctgggctccattcgttcacaactgcagcacctgggtgtaccatccatttcatgtgaanggcagtacttctgcaaccagaaacgaagtgccctgtactcnatnaanccattcnnatttgtgggaataaattgttgnagacatcacattttgg

SEQ ID NO: 4869 - DNA, 744 bp, Musa acuminata
  misc_feature (14)..(14): n = any nucleotide
  misc_feature (77)..(77): n = any nucleotide
  misc_feature (80)..(80): n = any nucleotide
tgcttctttatttnggagagttgactgaccagaagacattattacaacaatgaatcagtaggaaaacaaaagcgcanaanaaatagctagtgacaaatagatgaatcacaccctctactagttcagctacttgtaaaagagaaattatgtacattattgcaattatccatcaagtaaatagaatatatgctctttctaaccccccctgggtggccttgatatcatgcatcagatccgttcttcctgatccattattctgctgataggtaacgctgactaagttcatactttctagcttaggccagaacgtagtgccaggcgaggtcatctctagtcaggtttcaagctgctggccagaaggattcacttatcaatttcttcaggaatgatggcctttcctaaagacaccagttgcatctctgccctccatatcatgtagcgaaattcaacacggatatgaggcacgtttgttttatggatatcatttccttcaggacctctcttatagtagctttttccaatccaatgcgacttgagagcatgtgaaaaaccagactgtaaaactgaattcctagcaatttcacataaatcacatgaacttagcttccaaactgaggctgcaatgctgtactcctccaccaaaggttcctttgttaggtggatttgcagaggatcatccgttgaaagtgaaacatttagacctcgaaggaagaatatcgggatgggttcgatgataatcaagaa

SEQ ID NO: 4870 - DNA, 490 bp, Musa acuminata
  misc_feature (2)..(2): n = any nucleotide
  misc_feature (478)..(478): n = any nucleotide
  misc_feature (483)..(483): n = any nucleotide
cnctgcatacaaactgttcttaacaactccattactgggaactctgatgaacatcaggttggtagacacagtagttttcatccttcatcagcttacaaaagcttttcctcagctaacccaaaaacagatctttgtcgagatgacaaaatgctcatagttttggtttctgtcgaacatatggaggccagtaaaaaccaaatgctcggattcacacatcaatgtacagggaattactcaggaacaaggatggttgcagttgcaaaacaagtcacaatttgcagcatagaacgggtctcctttcactcgttttcagcaatgtagtttggtagctcaccctggcaaaggtactcatcgcaatgggaagcagattcccagcctctacgaagtctaatgatatcctcggtgaatgttgaaacctgacgatccaataaaaacggtagacagaggcacaaattgtcttgtccagcatggcctcaanctganctatctc

SEQ ID NO: 4871 - DNA, 243 bp, Musa acuminata
  misc_feature (30)..(30): n = any nucleotide
  misc_feature (43)..(43): n = any nucleotide
  misc_feature (73)..(73): n = any nucleotide
  misc_feature (132)..(132): n = any nucleotide
  misc_feature (137)..(137): n = any nucleotide
  misc_feature (168)..(168): n = any nucleotide
cctatgaacaaaataataaacatcaaaggngtctgctcagccntcaattcccaccatcgcctcggacctccantacttggccttctcaaacccgttgatgcagtactggaagtcgtcgatggtccgatcganctccncgtcggtgttcatcacgaacggccccagttnggctaccggctcgcccagcggctccccgccgacgagcacgaaccggaggggcttcgcgacttgttccacacaaca

SEQ ID NO: 4872 - DNA, 632 bp, Musa acuminata
ccattatttaaaatccaagaacaataatttttagatgtgcatgaatcacaagctgtcactctggaatagaatagaatagaatagaatacttctcacaaaaatgtctggtagcactcagaaggatttcttttcgtatgaaaccaagccatggcactcctccctccgcctgtgcagctcctgttcggacctcgaatcttagcacctccgaacgtaacagatcatgagccgactccaaagatgatgcaccaagatcctgaaatccttgcttgacagcttgcatggtgtaaggaataaacttcaatatggagcctttgtcagctacagcaccaacaactccctgagcaaccttgagcttcagtgtgtcccccaagtagcgggcatcactaccctttgtcatagcttctaaagagcccatgccccgatacttcttgactcggcgaccattcagatactcataaacaccaggagcctcaccactaccagctagaaaactgcccatcatcacagtagaagcccctaaaaccaaagctttcacgatgtgtccagaatttggatcccaccatcagcaataacagggcacatcatggtctttgcaaaagatgcaaccttgtatactgctgttggctgtctct

SEQ ID NO: 4873 - DNA, 635 bp, Musa acuminata
  misc_feature (601)..(601): n = any nucleotide
ctagatataaaatccaatgtaacatcacagggtaacacaacataaacatgagttaccagaaagatgaacacttcagctgtagaactaatcttttccaaatctaaaagcacaaaatacattgcacagtttcatatcatcacatgaagccacggaacaacgatctggtctggattggctagcggtaaattccccaaccaaaatatcagcatcgtttttccatggaaatcacaatgacccatgtctcataagtccacaaatgccttaaccatcctatgaccgcaaatggtaatctacattgaaaccgcatggatcagatgggcttgcacctggtctcttatttatggtgcaatagtgaaagttgaggtttccagaattaatatcttcaatgtacattctcaaggtaacaatgattgatgaaaatgctagggaatcaaatggtatgtcatccaaagcaaaaagagcacattcgagtgactcagggcctggtgaaaaatgaggtgtcttcaatcttgctcggaatatgatgtaactttgggccaatgagaggaatatctaactgtgcaaatggtgaaatgatttcaacttcagcacatgcttcttnccgagtttctctagctgcccttctgcagcagatc

SEQ ID NO: 4874 - DNA, 702 bp, Musa acuminata
  misc_feature (649)..(649): n = any nucleotide
cagagatctacgatgtatataaagaaagaaaggtaaacaagctatcatgttgcattagaacatgatgtagctcacgggttaaataattggttcagttaaagggctcttactggtcgggtaaataacattagctaccgaaaaactaatctgttcctaccaagtttctttggctcttccagccaagaggaacaaatagaaggaacatagagctagttgcaacatagtctcattcaagcattaaggcctttatggagagtcatgcgggcaagcagatgtgattcagcacatgaaaattgccagggttcaattgtcatggaactcacttcagtttgagattgaccgagatatgcgtggcctcactggtgtcttcgaaggactcaccctgataggtagagctcccagaatcatgccactacaacccagagctgcgattgcactttctgcctgaacaaattcaacgaaagcaatacgtgtagagtgtatattatcaccgagaagtcgtagacgagaaacctcaccacagaaatgctcaaacaaagctttgacatctgtttgagttacctttttgtctatgtttgtacagtaaactgtccttatgaccatgtccctctcatcctcagacttaggaagaaactttggattcacaggnacaattgcagtctttgaaggcaagaccttgactggatagaaacccaagcacag

SEQ ID NO: 4875 - DNA, 635 bp, Musa acuminata
  misc_feature (577)..(577): n = any nucleotide
  misc_feature (599)..(599): n = any nucleotide
  misc_feature (604)..(605): n = any nucleotide
atcataacttcatatggatgaaaatgcttataagcttaaatagtacagaagcaaaagcttagtgcgtccaatatttcttatacacatttactcacttaaccgggcaataccttaaaagtaagtgggtgtgccgttcctgcatctccaccaatcactcaactttggtttgtattaattgatattagtacattatctttacttggtctaccatctttggttatcatccgcagatggttttgacaacaagcttcttcatagcgctactcttttcgtcatagaaatcccagttggatcaccaccccactcttcaaacgcaaccaacaagtttccagttgggttcagccaagcgcgaggaacatgataccatttttgagaaggctccccacaattagtctggcatttcttctggttgtatgtccctctgtaatcacaccaatcacaagaaccatatgccttataggcaggccagtatctgccaatgctttgtccattgatccatatctgacctttgcccatgctactcatgtctaatgccaatggctcgttcccagctggagcattaaagaaagccttgtanccaagtcaagggctgcttgttncgggnnccaccacttaactgaagaactgccactaag

SEQ ID NO: 4876 - DNA, 628 bp, Musa acuminata
  misc_feature (4)..(5): n = any nucleotide
  misc_feature (612)..(612): n = any nucleotide
gagnnaatgctcagcattcattcagaagtatttgagtacaaatcatggaaaaccatatgcaacttgcagtatgcagcttgatagaaatttgacagttgatacaaaataccagctgcaaacaccaaacatttagaaaaactatagaccctctcctgacacagcagaggtactcagtggagaagcattgctagaagaaatcaaattcaagatagttatcagatcctttctgattgattgcaggtgcagatttttggcttgttgatgcaataggctgtggggacctgtcgatctcgacaggtctcgggatttctggggggcttgcacaccgtatcaaggcccaatttacgccctcgaagaacggatgctgctttatctccgtagccccacgcttatatgcgagcctgtgctgtggctctttcacgagcagtccccttatcaggtccctggcagagaagctcacaattggggaatccggaaagcgcaatggctggccgatgacattgaacaatgtggccctattacctgatcccttgaatggagttttcccgtacaaaagctcatacagaaagatgccaaaggtccaccagtcgacggcactcccatgggcccttnaccttgatgatctcaa

SEQ ID NO: 4877 - DNA, 660 bp, Musa acuminata
  misc_feature (5)..(5): n = any nucleotide
  misc_feature (7)..(7): n = any nucleotide
  misc_feature (19)..(19): n = any nucleotide
  misc_feature (21)..(21): n = any nucleotide
  misc_feature (24)..(24): n = any nucleotide
  misc_feature (242)..(242): n = any nucleotide
aactntntccaggctatcngntcnattattccatccgattttaacccatggaatcaacatccattacaacccatgcacatgttcagtaatataattacacagacatcttggggaaaaagcagagcaacaagccgatacgacatacaaatatgtgaatcgaggtacatgaaacgctcaaatggcagcaacttcatagtctaaactaccacgggacgttccatatccaacacgatccttgtggnttcccaaacaatctgtccatcaatgtagtgctgtctacatacaggcatataaacatcagctccaccaattagttctgtttgtttttcctttgttttcctcaaggtaaagaatggcacgtccaccacacaactcacaccttgcggtaagcttggtaactgaattagctagcggaatgatgtcaagcaccgagccaaatctccttcttaggtagtcaccatccaagcctgcaacaataacagtcttcctatcacgatcagctgccattgcagcaaaaatcataaagatcttcaaagaactgggcttcatcaatccctatcacatccaacttatcatatgcttcgggctcctagtctttctcggaacatagaaagcgctgggcagagccatgcatgggcattctcgtaaccatcatgtgtc

SEQ ID NO: 4878 - DNA, 595 bp, Musa acuminata
  misc_feature (588)..(588): n = any nucleotide
tgaaatacgtgcgtagacatgcacacaaacagccttgctttccaagtagtataatactctgcgaagtgattagcatgtgaagatggtgggcttcccaggctctgtgatctccacggtgccctcaagcatcttggtcaccttccccatcgacggcctcatctccgctcggtcctgtaagcaccacatggctgtcttgagcattcgatccaccagctcgaagtgggcgcggttgtcataggaatccatgatgtggcgatcgaggatgtcctcgatcctctgctccacatacaccttctcgaacgcccacttgggcatgtaccagtcttcgctctccagcgacgaccgctggaactctgagctcctgaccccactcacgatctccagaagcaccacgccgaagctgtagacgtcggcctttgcggtgatcggctcccgttgaatcacccactccggcgccaggtagcctcgcgtccccctgattcgcgacatggtcaccttgtccttcttgttcgtcagttcgacaggcgaaattgacacttttgggagaagtcgtctcgatagtatgtctccggttatgtcgagtgaganccactga

SEQ ID NO: 4879 - DNA, 561 bp, Musa acuminata
  misc_feature (12)..(12): n = any nucleotide
tcttatcgtacngtacacgaaaaaacaaacactccgtagcatacacgaaagcaaattgaacaatgatccgtgcacagacgatttcacatttaaaaccttgtctgctccatgcacccaagcagtttcacccacagagcatcactgaaattgagatggatgcaaactctttgtgtgtccatgttgtggatttttgtgagacacagtgatcgcgatatcagcgaatgggttggggttggggcattggctctgacagccggaaccgcagtagtccgacgtggttccgcagtagccgtactggctgcagcactgcccgtcggggcacaacgctcccgctgcctgcgatccgcacagatacccggagtcattacagtacgcgaaagtgctcccgcaatagccatacttgctgcagcaaagcccatcgaggcacgtcttcccccctgccgccggtccacactgttgcgcgaggctgcccaacagtgaccccaagctaaagataaccacgaaagggagcttcattttccggcactccaagcagaagaggaggctcgccatatatagact

SEQ ID NO: 4880 - DNA, 519 bp, Musa acuminata
  misc_feature (14)..(14): n = any nucleotide
  misc_feature (498)..(498): n = any nucleotide
ctccacaaacaaantggcagcaacacaggcaggtttcagtggacacgagcacaacagtatccattttgaccaacgtgggtcgaccgcctctgaccaaacgcacacacgaaggttcccggatcctacttgtggtccctgggcccaccgaaaaacgcagacccttcgctatatatagaactcactccacgaccaagaaatcttcacaaccactagagatcttcttgtataaacatacataaagcaacgagggagagtgagatcaggaggaagatagagagcttacttttggcttccagttgagcgaagacacacttaccattagttagtccagcggagaagacgaccatggggaggacaagagacgccgaagcggagtcaatttgccgccggggttccggttccaccccacagacgaggagctcgttgtgcactatctctgccgcaagaccgcctgccagtgcctgcctgtgcccatcatcgccgagatcgatctctacnagtacgagccttgggaacttc

SEQ ID NO: 4881 - DNA, 651 bp, Musa acuminata
  misc_feature (4)..(5): n = any nucleotide
  misc_feature (17)..(17): n = any nucleotide
cacnngatgaatatatngggaagaataatgcgtacatttgtggattgacaacaaaggaatacatgtttagggaggataatgatcctatacacaaaaagaaagatggattattccatatatatcatatggacattgctcggtggatttggaagaagaatgtggtgctggctcatcttctctggaagttgaacaccttgatcgagaaggcgaagacgaaagcaaagagcacggtgaagccgaccactgcaacagccacgacgcccaggaagtcatgccggaacccgaagaatcgcctgacgtattcctccaccgactcaccaccctccattgtagtttggttgtcgccgaactgtgaggcaacgagcccatacagcgtccacgccaccgggcaagcccacgagtaccatctccaccacacagggatcctaggccgaggaatgagaaagccggcgaatatgttccagatcgcgtagaatgcggtggagacgatggcggcgatgtcgctgttcggcgtcatgggccaccgccatcatcccgtagaacgtgaagtacatgaaggtgaagaacatgaagaagaggtaccagaagaacttctccattgtccactcaaaaccaatcatactgtagacgatgagtccgtataacacagtc

SEQ ID NO: 4882 - DNA, 638 bp, Musa acuminata
acctaaatatttattgcaaacaatgtcttaaaaagcacaaacgtgacaatatgttaagcatctaaaaaacattaagtgcatgactttaaaatagataaaaagttctaaagtaaccacaagaaaaatgggatgcaggctggaaagtcctgcagagaggtcccaaggcaactgatgcaacaacaaagagcaacctgacattttcttaatactaggacaccttaaagcttgtcttcaaattcagagagaggggtcatctgttccttgaggcccttgcgctttctgatatcactcacaagctgccctgcctgagaacctggctccaacgggtcagacgacatcatgtcccagtgatcaaaaacacactgagggaatgcctgccccgatgttgccgccctcagagtgcttgagaaaccaaaagactcgataaccggaagatatgccttgatgttgtacaggggagttcctggcctctgcatctcctcaaagacatggcctctcttctggttgaggacaccatagatgccacccagtgcctgctctggagcctggatctcgaccaagtacactggttcaaggagtcttggcttagctgtcaattgagctgcatatatgacctcctggctgttggatcggacgcg

SEQ ID NO: 4883 - DNA, 585 bp, Musa acuminata
atcacaaacatgggtcttgatacatcagacaacattgattcaattaagcttttctacataaaagttgattcaaactaataggaattcagcagtcctaatgacaacaggatctctatagttaccgcctgcttgatatgctgaaggagctaaccttcatcggggtggccacaaccagaggagcctcgggagattcactaactgcaaacttctcgtgcatgaagcggctgtccacgattgattcatccttcgggacgaccttgtagcaatagcaactcttcagcccttcctggttcttgtagcactcgtggttgctgatctttacctgctggaagttccagatgacgctaaatttgccgacggtcgcaactaaatgcctctcctgcttaccattttcagtcacccatgaaaactgccccccatggaatttattgttctcgccagccagatgtgaatccaatggagtaagcttcagtaatcttggagcagcaatcctgttccccattcgcccagcaaaaccagtcttttcctttccatctttatccttaaataccgtgcttataaggatcaagtatgtatctgttgtgc

SEQ ID NO: 4884 - DNA, 774 bp, Musa acuminata
  misc_feature (771)..(771): n = any nucleotide
gttacccacgaattgctgtcgctatcaagataaagatatgcatttagtctgaagagtaaatctagtagtatgcatgtaaatatagtatatcacaaaattcttggactaaaacaggaaaaagagaatcaagtccagcttagaagcaaacaatatttgacttgggacttgtgttacctcaaggggtttagaattcagataaaagagtgtctggagaactcaatgccaatgtctgatacaccaagttctccactggaattctcctccataacatcctagtacaaataaatgccataaagtatgagataaaaggctgaaccaggactaaagcagcttctttctctcgaaaaatgtctttagatgccataactgcaagcctgccaccgaaagacagacggcaagtgaaaggaaacttagccaagccatcctagagttggtagatctgttcatgtcttgcatctgctcctccctttcacgcagatagaacatttcatcatggatggacttaatagtatcttccaacttcttcaactccaattccatgacatcgatctgccccttcttggcgacgttaggccagtccttggcagtgacgccggtccgccactcgaattccaccaccatggtggcaggcggcttgtgatcgggcgcccacaagcacgccaagtagtcgccttcctcgttcgatgtgaacgcgaagttgcccgagtccaccagatccgcgtagtggatgctattgccgtacggcgatgtcactctgaaggtgatcttgtngga

SEQ ID NO: 4885 - DNA, 596 bp, Musa acuminata
tatttatactgcttatttagcatcaagcattcacaaaatcttccctactaacaatccacacaggcgataagttgataccgtaacatagatatggaaggatcaaaaggtgaagggggtagatggcacattgcatcgataatgaaacacgttatttcttccgagccaccactgcagctattccacctaccagaagccccacagcagttgcagcaattcctatgccaatcacgccatctttagcaattcgatcctccactacctttctcagggtttgagcctgtctccagtctggtgcaatctctaaacatcggtccaagagttgacgacttcttgggtagtctccatttctgtaatacccaacagccagcagataaagtttctctcttgattgcagtggactagctgaattgtccaaggaagcttcaagcatggcaattccacgattcacatcttccggatgcctggaatgaacaagagcccaggacaacctcataaggctttcgttcttgctttctgcattcccactctctgcaacctctctttcacagccggcgatgatgtcgcgatcgcaccaggggatgttatcgccaccgctg

SEQ ID NO: 4886 - DNA, 1058 bp, Musa acuminata
  misc_feature (742)..(761): n = any nucleotide
ttatcactcttgaacatcatgtctatacacccattacacagaggagctctaagagttggaagagagtcgctatctctacctttcttgactcgatttaaacctgtccgaaacctacagataccatatggaaatccttaccgtagatgtttgaggactgcaactgctgctgtccttgctgattctgctgccaagtgcccagaccaacgagtacagattggctttcggtcttgatgtcatattgcagaggatgactttggctttggattgttgccgatgctgtaatggttccttgaaggtactctgaccatttgaggtcctcgtgttcccgttcgagctggacgtgggcgttcttttctggcgtcactccgagaaagggaggatgccaccgtcgaaggaggtgctgctttgcaactcgattacgctaccagtgttcatgctgctccggcgactgttactcaaataaacatcactgctgcactgaatagcatcaatttcatcacgtaaaagatcgatatttggtttcaggctcatcaaagctgagatgtttccgctgggaaccgatagcagaactgtggatatcgtgctgcaatttaactcctggttcatttcgaagagaggagcgcagtcaggggcaaagcctgactgtggaagaggggataagtggcagaccgatgagctctcatggtcgtggaagaagcctttggtcggcgtcaccgaattcttccatgttctgctctcgccnnnnnnnnnnnnnnnnnnnnccgggttgtgtaccgaatgcttggttttctccaaggttgtggcgggggctttgagatcaccggagttagaggtcttgtcttccaactctgcgagcggcttgtgagtgttggggtcgatgccactctgcctgagcttcttcttgacgcaggagttccagaagttcttgatctcgttgtcggtccttcctgttcccgagcactgcatggagttcaattatgagactctcctcctgctttgagaacgtccctctcttgagatcaggcctcaggtagtttatccacctcaacctgcagctc

SEQ ID NO: 4887 - DNA, 652 bp, Musa acuminata
  misc_feature (15)..(15): n = any nucleotide
gattaatggctttanttgcacacaagcaaagaacaactcgtgaataactacaataccatcatcggatttcagtggttcgttccatcaaattctactacagctcatcaggacatgcatgcaacacgaaacttcataagatcatgttttctgtctagaaaaatataaaccagatttaaaaagccaaggaaaacaccatttcctagcaacttttattaacttgcagggcctacaagaaccccctgcgcagaaccttctttttggttggtgtcctctttggtctcactgtcggctttctttatcttgatcttatacttcaattcaaactctgaaatctccttcttcttcctctccaatgcctcattgaggcgagcaatgacctcctcgagaccttccttgttgcgctgcacagcaggcaggacatccttgatcgtcctctcgaccagcacaccactgaccattcggtagcagcgacgtgatggatcaagtggttgtatggcaccgattacaagagagtgctcactgacttccatctctaactcagtgatctttgagtagatctggttaatttctgagcgcatgtttccatacgtgtttaaatttagatgagctatagatcgttttcttgtcacagagttacttttctcaaagaatc

SEQ ID NO: 4888 - DNA, 570 bp, Musa acuminata
  misc_feature (6)..(6): n = any nucleotide
  misc_feature (8)..(8): n = any nucleotide
  misc_feature (21)..(21): n = any nucleotide
aataantnatctcatctatancagaggcaacaagcatttgatacatcaaccacatggagtggggacgtgaccttattcagaaaggaaccttagccataaacaacaaccataaactgctgctacaacttcgaagagttcctacagtacagacacgcaaatactttgggaatgctggaaccaactctcgcatcaagtgaaccaaatccccatcccttcaaagctcaagttctcatttgctacaatggaagattccggtgggtgtacactacccctttatcaccatccacaacttgtccattacctctcaaaatccatcgagtggttaataatccttcgacaccaactgggcctcgagcatgaatcctacttgtacttatacccacctctgcaccaagtccaaaacgggctccatcacagaagcgtgtgctagcattgtgaaacactgcagcactgtcaacttgatggagaaagatctctgcagctgcaagatcctcggcgactatgcagtcagtatgtgcacttccatattgatgtatatgggcaattgcaccatgtatatcatcaactact

SEQ ID NO: 4889 - DNA, 612 bp, Musa acuminata
  misc_feature (85)..(85): n = any nucleotide
  misc_feature (509)..(509): n = any nucleotide
  misc_feature (529)..(561): n = any nucleotide
attaaacaatattcacaaactagagcaatcaatatggacaaggaaaaaagaaaacacatttgattcatctatactatcatacacnaaagacaagaaagatgtgctttacaagactgtaggtcagacttgatataaatctgatctcagacctcagaccatccagataacttcctctcttgtatatctctatctttatcttcttcctctatgcctcagttttgtgcctctggtatatgattctgacaagaaactcccctctctatcaaaaatgctgcagcatgccatgacaccagaggattaattctattaattcttccagtctccagaagaacacaaaaaaagatgaaacccttgtcagctgcataatctaatagtacaagccactgcttgagcccaatacctcagccttgctttaacttcatctggatgatcccctgggctggagattctccaattgggcgatgggaggagacgtcggcgacgcgcacagatccatggactcgccagangaggagcggtcgaacgagcnnnnnnnnnnnnnnnnnnnnnnnnnnnnnnnnnccaagaacctctgggtcatggagtagcagagctccaaagccgggagcgtgt

SEQ ID NO: 4890 - DNA, 711 bp, Musa acuminata
  misc_feature (5)..(6): n = any nucleotide
  misc_feature (30)..(30): n = any nucleotide
agctnnaagataccccagtgatgcggtatnataatggatttagaattcattcacagctagatgtcatttagtccataatctcagctcggatctgaaccaacaatgaccttataaaacctgttaactaatatggaggcaccaacgtattccgcatacaaggaaacctcaacgatgatgtttggtaatttatttggaaaattaaagtcaactccattattggaattcgtctgagggtacttcaccaagtgaaaacagatgtaaaaacatcaaatttaaaacaaaccaagtggtggtggaaaggcagcacagattcagcctacgcaatataagtcttacttcaagacccggcgaccttgaccaaacaagcagcaaccctaatcggaatcctttttggggccatggagctcgtgtgggcggttctccttgccccagccgacgccgcgggtggcttccaggtactgctggaccagatggcgacacttctggaggtggttgacgccctcgatgcggtagcaccatcggaggcgctccctgatgatcttggcggtctcgatctggataaacttctcccgcaccaagtactcccggtactctagcatcgccaccggatccccgtagggtttgttcggatcgaagtcgggagggctctcatcgaactccaccttcgccttccgcaccatctcttccttcctccgccctcgctcttctttt

SEQ ID NO: 4891 - DNA, 716 bp, Musa acuminata
  misc_feature (42)..(42): n = any nucleotide
  misc_feature (572)..(572): n = any nucleotide
  misc_feature (578)..(580): n = any nucleotide
  misc_feature (582)..(582): n = any nucleotide
  misc_feature (701)..(701): n = any nucleotide
  misc_feature (707)..(707): n = any nucleotide
cctaacaagaagaagccaagtgatgatatcatttatttcgcnaaacaatttcttgacgcatggcgtgtgctacattattactggaggaaaacaagtcatacattcatctcctattccttcgcttttgttgccaccaattcaatcaatcgtgtcacgttctcatacgaagaacctccctccatcatcgctttccgtgccttctctccaaattcttcagctctccttctcctctcttctccctcctgccctccgtccatcaacctctccacggccttagcgacttcctccctcgagatccgcgctccctcttccggcgattgcctcatctgctgcatggaggtcttgacgcccaccgcgactccgatcccgagcacatccaggatcaacttctcgttgaggaattgctccgagaagagcggccatgtcgccatcggtacgcccgcactcgcgctctccagcgtcgagttccacccgcagtgcgtcaagaaaccacccaccgccgggtgcgacaggatcatcacctgcggcgcccaccccctggatcaagagccctgtggagacaccgcctttcncgagcnnntntgcagccatcagatctggaatatctgagttgtagaataatgttagggggactactgctccatcagtaggagcattgcagtaatgtcatttgattcagatgctttgtggattgtttactnttcaanattgtcctc

SEQ ID NO: 4892 - DNA, 610 bp, Musa acuminata
actaaagtatcagataccattggccttgagaatgctgggaaatacctacaagagaagtacgggggagggctatttcctattctatatatttggggaattgggttattagcagctggacaaagtagcacgattactggaacttatgctggacagtttataatgggtggatttctcaatctccgtttgaagaaatggagcagatcattgatcactagaagcttcgcaattgtcccaactatagttgtttctctattctttgacacttatgattctgcattggatacccttaaccagtggttaaatgtcctccaatcagttcagatcccatttgtcctcattccgcttctcaccttggtgtcgaaggagcaagttatgggggtttttaagattggacctaccattcaagtaagttgtgaatcttaaatattgttatgaaattttcttattatcttattccgatgtgtttcttgtctgagccactattgttgccaattttttgttctcacacctgcaaatatccttctcttttcttttcttaattatttttgcattatactttttaacaatttagagtgtgggaagttcaagaacaaggtggaatattctattg

SEQ ID NO: 4893 - DNA, 623 bp, Musa acuminata
  misc_feature (10)..(11): n = any nucleotide
  misc_feature (13)..(13): n = any nucleotide
  misc_feature (586)..(586): n = any nucleotide
  misc_feature (600)..(600): n = any nucleotide
tgaataaatnntnataaatataaaacatatctcgacgacacgaggacagggccacaccacttttcctcacaaaataaaaccatttacggaaaatgatcaacaaactgtgaccctggatggtaaacagatactagctagtgaggtagcttataaaacagatggtagcttataaaacagatggtaaacgacagcttacatgcatccttcacttcagcacacagacccatcaagtcaccatgtaccgccataggaggaagcccgctgtaacatgaagaagcagcaaaatgagttcccatccgagacaatcttcaatgcaatcttgtcagctcctccactctcttgcaaagctcctccaatggaactcccatggaggatgctatctcgtccatccgactgcggctgagatcaaggaaagactcgatcaagtctccatccaagaagttcctggcatccactgtcttcttttcgttgttgaacgatcgccattgctcatggctcaggccacccaccccctttattaccttcacgaggttggctggagcttctcaaggaacacatattggtcatgaggaagggacgctaccancccaatgacaccantgatagtgccaaatataaccgtc

SEQ ID NO: 4894 - DNA, 649 bp, Musa acuminata
  misc_feature (7)..(7): n = any nucleotide
  misc_feature (10)..(11): n = any nucleotide
  misc_feature (17)..(17): n = any nucleotide
  misc_feature (19)..(19): n = any nucleotide
  misc_feature (22)..(22): n = any nucleotide
  misc_feature (25)..(25): n = any nucleotide
ctcgacngtnncgatangnggncancattcatgttagaacaaattagaaacaaaaaggcttattattgttgctatctttgcttcagttcaaacgccaacgtttggaaaaggtacaaatgtacaaacatcacaactcattttatgtaccagcaatgaacatttttcttcaactttaatgatgccagagaaattatgcggttaaaagagctaatcgatgccttcagtttttcttctttttcctggaactgtatcagttttgctgttgaagccatgcttgaattgcagaacgaaggccgtaattggggattagctcgtgatgagaaagcctgaggttcgtcatcggtgatgtgtctccgccaccacgaagccatccttcaatagcctcggcttcatatgtgaagccatctgctgcaatttgtggatccctcataatctccttaaatattggacagatgaagtaagatggaatgctgctgctgctgacttctgggactaatctaatcgatgaagttgataacctgacaaatgagacagacttcatcaagggctcgagtgtctccatggcctcttttgcatctggacggttcctcgtattcatctcacagcactttagacccagtttgccaacttctcggctgcacgtaaggca

SEQ ID NO: 4895 - DNA, 747 bp, Musa acuminata
gtagaattagctactatctaaattgtatctcaggaacattccatgatcaaataaaacaggaacacgaaacaacctttcggacagacgaacagctctcggtaaccgacattttttacagtctttcttgttaacatttcttcatcaccatcttttaatttacacccatataaaccttgtacaaacaactatcttctctgtgaagacatcatatatgtgctaacccatctgagcctcagccatggtgtgacaaactattagttcacctagagaatgtacaaacttcagtacaagcagcattattattgccaactaagcctgtaccagcctacacgcaaagccgggaagctcacactagcctcagctgtacaatgtcattctcatgcaatcgaagatgcatgctgggtctgaaatccgatccgccgttccccggctgcaacaagtttctctacacgagcaactatatgctttccgtaggtatattttttcaaagcattcaagtggacctttattcgtgacagaatcagttcacgttgctgatcatcacaagtctccaatactttctgtacaacatagttaccaaactgatctttcatcatggcctgaagaggtcattctcatcagttgaaccaagcatttcattcaccaatatttgacgttcctcgagactgccaaaagtcaaacatttttcaacaacattcgaagcaaacttatgtagactcatctgaactatctgtccggctaacttct

SEQ ID NO: 4896 - DNA, 644 bp, Musa acuminata
  misc_feature (598)..(598): n = any nucleotide
  misc_feature (608)..(608): n = any nucleotide
ctatttccatcacaaattgctgatatgaaaacagatgcgagtatttggcgatgagaatctaaacatcggtcaaaattaatgatgatacaatcataacataggcaaggaagaacaagagagcgatctgcatgaaaaactttgggttgtccctcaagcttggagctgcaactgcccttgcaatacgttgagaaagtcgagggagaggtaaactctgaataaacacaactccaggacctgatagtgtggccatcaattggttgtcacccccaaagaccactcttctcattggatgggagtgcttcagctgaaaattgatagtgcatgtcatagcaacaatacacacagcatctactattaatacttctccaggagcaagaattttctgcacgacagatccacatcccacaagaaatgcaagaccctggcctactagcttctgtttcaggatcacctctgcaccaacctcaaagttgcggggtctttgatcaacattactgatagttctaacatcattgacagagcaaagaaatgcatctggctgacaaagaatctcaccaccaaaatttgccagtcaatcggagttcttgcagggatggtntgcattccancaatcatcttctgggcaagatgcgagaactatgttg

SEQ ID NO: 4897 - DNA, 445 bp, Musa acuminata
  misc_feature (11)..(11): n = any nucleotide
  misc_feature (13)..(13): n = any nucleotide
  misc_feature (16)..(16): n = any nucleotide
  misc_feature (132)..(132): n = any nucleotide
  misc_feature (225)..(225): n = any nucleotide
  misc_feature (394)..(394): n = any nucleotide
atggcattagntntantatatcctggataatcactaacagcaaatcagcagcagcctcagaagatgaaatcttggacaagagtaaaacatgctaatggagactacagataagttaaggtaatggagaaacanttggctgtagaatccgatttcctgatctcaaaataccagtcagaggtgacaaaccttgtctaatcatgcacttatccataatgctacaatagncatattttaatggataagctagaattccagtttggcaaacatggttgatggtgactctgtaaaggtgggtaaatactggagccaatctttcgcacaaaagagagcctccactgtctctggacgtaaggaactccgatactcatcaagtactctgcttccagtccctganccaaaaatggaacatcctgtacccacaatggacactggaatgcctaatatg

SEQ ID NO: 4898 - DNA, 648 bp, Musa acuminata
attagatctagtcataagaatagtagactttacttgaaccatcatctaccagaaacaacgcacagtttgaaatcaaaaacatctcttagatatcgaaaaagcaaaggtagtagtgcaagatgacgacataactatagtaggtaggtgatgaaggacggaccgatcgggctaatcgttggagggattgatgagatcaatcgatctcctggagagagggcgcaccggcaacggcggcggcgacctcctcggccgagaacttgcctttggccttgtcggcggcccggccgcgggctttgcggtcgaggagggccttgcggtccttgtccagctttagcttcgttatgacgaccttggaggggttgatgccgacgttgacggtggcgccattcaccttctcgcgggtgatgcgctcgacgtggatgacccacttccggcggtatacctgcacgaccttgccctcacggcccttgaaggtgccccgcaccacctgcacctcgtcgtccttgcgcacgggaaccgaccgcacattgtacttgttgcggaggtccgctgagagcggagcgcttcatcagcacccgccggacgctcgacggggcagtgaagtgcgccttccgggacttcctccgggaactcgacacgcgcgcggac

SEQ ID NO: 4899 - DNA, 657 bp, Musa acuminata
ttgaatatggtaatatcaatgttgcagattgtacaagggagtcgagtaaatgaaggaaagcagccgaatagattttgtgaatctggattctcctatttcaaaataagacattcggaatgtaaaatatagctgcatatacaacaggattaggaaaaaggtactggattctcttgaggcttcttccatgattcaattaggaaaaaggtactgaacaggctgaagctttgtcaaccaatcactggcatggttcataacttgaaggtcacagaacggaaatctcctgtgcactttgtgatggcctcattagctttctgagttcccgatttttcttctctcttctttttttctctgtccacatattccttcaaaagctcctttgcttgaactaatttcgacagaagattgcgatacacatcaagatctctatccacactgcgtttatttatattcagtgcagcacaaagcttttccaagactgtaggttcagttgcatttgccagctcaagtagacggaacagtccaatcgcaaagaatcgactgtagctgaagtttcccttactcagtgcccgctctgagatatctttcaaaatggtctctacttctccttctctagtggagaactctattaatgaattagcagtctgagcacgagcccac

SEQ ID NO: 4900 - DNA, 681 bp, Musa acuminata
  misc_feature (13)..(14): n = any nucleotide
cattaaattattnncagaacaatataggcactaagagatttacaaatgacaacaatgatgacgagttcaatagaatttttgacatccttttctatgatttgtgtaacataacttaaccgtgtaatggcaccatgcttaacataaaaaacgaaaaatgaggaaaagaaaactgtgcaaactctagaatcgctactcacaaatatgctggttagtacccttcctatcaggtgtatctccaagcaaccagagcacctattaagatgagtgtatataactaagagaaccaaatgtagaagtggttgatatctgggggatattaggttagccagtgaccaaaactgtgtgtgaaggaatcaagggcgaggctagaccctgaacagataatttaggtcctccaatgtcaagcgagtttggccagcaccagattcatcttctccaaatgcggaagcaaccatctcccttttcttttcctggagagccaagatgcggtcttccactgtgtccttcactgtcaagcgtgaaacagtcacaggacgagtctggccaattctgtgtgctctatcaattgcctggtcctcagtagtaggattccaccataagtctagaagaagaacatgacaggctaccaccaaattcagaccaagacttgcggctttcagagacataatcattacagtaacc

SEQ ID NO: 4901 - DNA, 615 bp, Musa acuminata
atgcaagataactacttgattgtagacaaaccattttaagcaatcaaatacagatatcaaaagaggatgtccgcatggctatagtaaccacaatccacacaaaaatctaaactttaagcgatataatccttaaaagggaacttgttttcggaaaagatcgagcccgttgtgccaagatcccgtctcagttcctgcggccagcgccataaccgccgccggggcgcgactggtacgggtaagtaggggcggagggcgcatcggcttgctgctcgacgccggggatatcggtcataccaagggacgcgagcatgtcgaccgtatccttgtcgacctcgatgtggtcgaccttgatggcggactcgtcggggacgaagtcaatgcggcgctcgcgctcctcctcctggagcttaagggagatgccgcggacagggccgcgctggatgcggcgcatgaggtgggtagagaatccggcgatcttattgcggaggcgcttcgaggggatgatggccacctcctccagcatcttcttgttggtgtggaaatccagggtcatccgcgagtagtaccgctcgatgacctggcgcgacgacttcttaccgtcttcgtccggacgcg

SEQ ID NO: 4902 - DNA, 574 bp, Musa acuminata
  misc_feature (556)..(556): n = any nucleotide
attataacattttccagacgaatactcgcatttttctgcatttgtgggaaaaataaatggacatactatgaactaactacgagtgctacagcaaaggcataaaaagttgctgctaagtgcataatatatatacacacctgaaaggggaaatcgaaaaccagaaagagaaacaagggattcattcaccgatctgatgtggagcagttgattgcatcggtcttgatcacccttgtgttgtacgaaccacaaaagccacatttgtggtaaagccagtggaagtgagatgtgccctttttaccacagtcattacatagtatgtcctgacaccgatcccagtactcctcaggaagctcttcagcagccaataaagcatcaagcatgccgaagtatacagccatgtctcccaaggatttgctgcaaattgggcatatgtaatgactgcaagtataggcttggaagcatgctgagtgcatgaaatgtccacacggcaaagctctgactgcttcacttgatgtaaatagaaaatcacaacaaattgggcaatttgctctagacntttctcacgacatttgtg

SEQ ID NO: 4903 - DNA, 622 bp, Musa acuminata
  misc_feature (12)..(12): n = any nucleotide
  misc_feature (593)..(593): n = any nucleotide
caaataattaantgtcaattatgaataaccatgaaacatctgtcttttccaaacagttcagaaattgctcagagtcgctaaatatgaattaaacaaaaggccgactggtctcatctagaaactcaaagtaaagcattacgatcgaggtttctccttcttttccttgaacagtgccaaaagggagacaccagacaccttcacaaccttaaaccttactccaggaatatcaccgactgcatgacccttacgaccgaaccctgcaatcaacacttcatcattttcttctatgaaatttaagcaaccatcatttggaacaaaggccgcaattttcttcccattctttatcagctgaactctagcacactttcggatagcagagtttggctgcttagcttcaatacctatcttctcaaggacgatacccttggcatgtgaagaaccagcgaagggtttcttccactcattgccaaggtgacttttcttgtacgctttgtctgcccatctctgcctcctcctgtgagttttgagcttacgcccagctcccataccacgagtcttccccatcttgttggaaaccgaagctcgccttcctntcgcgctctgtgcgaccgcgggctgcgac

SEQ ID NO: 4904 - DNA, 1050 bp, Musa acuminata
  misc_feature (40)..(40): n = any nucleotide
  misc_feature (42)..(42): n = any nucleotide
  misc_feature (87)..(87): n = any nucleotide
  misc_feature (99)..(99): n = any nucleotide
  misc_feature (201)..(201): n = any nucleotide
  misc_feature (205)..(205): n = any nucleotide
  misc_feature (350)..(350): n = any nucleotide
  misc_feature (489)..(517): n = any nucleotide
cgtgtacgtgttcactctcatcccatgtacggggagttcntntgacgcagagacgtgaagatcccgccggcggggaagatctacgcnttcaacgagggnaactacctgctgtgtgacgacaagtttcgggcgtacatggactccctcaaggatcccgggcccaacgggaagccctactccgcgcgctacatcgggagcttnttgngcgacttccaccgcacgctgctctacgggggcatatacgggtacccccgggacaagaagagcaagaacgggaagctacggctgctgtacgagtgcgcacccatgagcttcatcgtcgagcaggccggcggcaagggttccgatgnccaccagaggatcctcgacatcgaacctcaagaaatccatcaaagagttcctctgttcattgggagcgtcgaagaagtggagaagttggagaagttcttggcgtgatgactgcgaactcaaacaagaatcatccgccannnnnnnnnnnnnnnnnnnnnnnnnnnnnccgaaggaatttgttctgagaaaggagaacctgtaacacctaccattgttggaagttgcactgtgaagcacaaattgttggatggatatacagcttcaatttcttgtttttgtcctcgaatctctaattacaatttggtcttgtatctctaaatctggctcaagcactcctcctacataggattcgaatccaagaaggattggctagctaatccgggcagcatctgacaaggacagaaacaaagaatccatctccttccacagaaaagcaaagagagaggtccacccgagcagcacgatgttgaggtgactactgcagaacttagattgcactcgcgagagacgattggtggcggccgatgttgctggagctgatttgaaatgatcgattcagagcagcaacgaaaccaaaaaagaagatgaaatcgattgatgaagaatgctgcagacagattaatgttgatttgatggtgcaaggaaccaaaactgtattatgatagctactatatctctatgccaactgctagcatttgc

SEQ ID NO: 4905 - DNA, 677 bp, Musa acuminata
  misc_feature (636)..(636): n = any nucleotide
  misc_feature (640)..(640): n = any nucleotide
  misc_feature (652)..(652): n = any nucleotide
aaaatgttccttgggtctattctacagatatatggaaagattaaaacttatatctacttatggacccccagagtaattccaaaatttagacatgattttgtttcattcaatccccagcatctgatatgaaaaaccaaaaaggataaatattccggatcgaaatgaatcatatctttgttttgatttgacagactcacttctcatttcaacaaagaccactaaaaatttcaatcaaatttgatttgcctaaacgtattgtcttccatctgctctgcaataggaatggatgcgtcccaagtatatgctcaggcataaaatcgtgccttgtcaatatgcccacaacaggtgcccgcgaagaagactttggaataaccaagaggtgcctcaagccaacttctcggaaaagaatgagagcctttgcaagtgacatcgtctcaacaacagtgtaaggtgaagtgttggtatacggatgcaagtcaacatacatgtccatctcttcagcagtcaggtcgatcccttcaatgttttcatgcttgccggagccacgtttagcaaagtcctcgggctgaaaactgttttgaaacatcaatacttacaagtgtgcgagcatgaagaaatgttttcttcttcaacagnccangtaggtgtgccncagaatcagaccaaaagcactggtg

SEQ ID NO: 4906 - DNA, 654 bp, Musa acuminata
  misc_feature (627)..(627): n = any nucleotide
  misc_feature (634)..(634): n = any nucleotide
gtattgtggcaataagatacattttcaaagtaataacactgattgaacaacatccatttttccaatgtcaaaactcttgatgataattatcccagttggtggaattctttgtttccaaggtgtttgctgtacatggatgcaaagtaatgatagggcaccgggaagagcaatcaaatactaccctggttttttcctttaggatcaggacaggggattataccccatttcctgcgcacatcctccaggttctcgtgaaagtgcttctcgtagtacacagacatcagatctgtgcacgccacacctgccttaacagcccaaggaagatagtgttggaaaaagagtgccctttgctttctgctgaaccgtaatgagcctccgatgaccgacaaggcacacatcggaacaaacatttgctcaaactcgatcaccttaagagcagactcacctatcaagtttgtgggaaggccaaatagcacatgccagaagtcatgcacctcacgagcacgtgtggccacgtatgccagtcatctgtgtccatgaatcgaactggtgggcggtcatctggggagaagttcttgatcccatgaatgtgcataagtgagccaaatgtgctttcggtaagtccangcatgtncattgtgcgataccacatgt

SEQ ID NO: 4907 - DNA, 612 bp, Musa acuminata
  misc_feature (553)..(553): n = any nucleotide
aggactcttttacaagacttgtttgcatacagcgttcttattccagtactatactctgcttgttcactcaacaatttggatatcatcaagtttgcagagtccccagttgaattgtgggaggatcaaaagcaggttaatggctttacagttcacatgctacattcacaaattccatttgaagccaaaacactagagaacaactatattcatgaacttcctctttgcgaaagctagccaccacttgttaggggtgccattaggcctataagcacagttaagcagccttccacttgtctcctctcttatctgcttcaaatagttcctgaatagttctgcttcatcctgagaccgtggaacggaaaaaagaccaggaaaaggaaaacctggctctccaggcacaggaaccttctctaggcccaaattaatgatagctttgggtccccacagcaagagttctgcaaccctccagccgtttcagagccacattgatgtagaatgtcaagtagataaggagcttgtcagctgggctcttgatgtcaaaatttttaaaganaacatttgctcgaaagaaagttattgctcatcaacaatgtcgattttgtcttgatctga

SEQ ID NO: 4908 - DNA, 1199 bp, Musa acuminata
ggccgtcgtcgacgagatcggactgagcgagtggggttacgcctgtcgccctttgcagactaccacggttgctgggactccgaccctgaggtttcggggctctacctcgtccaccagatcaacaagcatggccttctctacttgcatatggtggagccgaggatgtccattgtggaaggcaggcgccaaatcccccaccggcttctgccgatgaggagagctttcaagggaaccttcatcgctgtcggcggatacgaccgtgaggaaggcaacaaagtggtggcggagggctacacggatctggtggcttatggtcgcctcttcatctccaaccccgacttgccgaggaggttcgagctcgacgcgcctctgaacgggtataacaggctcaccttctatacttctgatccagtggaggggtacacagattacccatttctttgaccttcggccctgagactatctcaactgagttgactttgaatcttgagccaataattctttgtgatggcattgtcatgatgcattatcgacactaaaaacaagcttgaacattctgtaatgaattagaggcttcggaaaagaagtgaggtcttatgtgtagacaagctacaattcatttagaatctccaaacatttaatgtgctgattaagtatactgaattaattgtccatatcaaatgaaaaatgccacgaaaactggattttaactgcaacagctgctcttctgctcgatgggttgacccttcatctgaacagtggtaggtttggtatctgcagtgtgttggtttcccattcttttcttaatttcagcacacatggttaagaaagctttctccacattgattgaatcctttgcactcgtctcaatgaaaggaataccaagtgaatcagcaaatgcctttgccttttcagtttccacaactctgtcctcaaccaaatcacatttgtttccaacaagaagcttgcacacactgtcactagcatatctgtcaatctcacttagccactgcttgatattgttgaaactttccatctctgtaatgtcataaacaataatgatcccatgtgctccacggtaataactgctggttatggtcctgaaccgttcctgtctgctgtatcccacttcaagcaaacaagatcattgcctcaaaatgattgcactagactataacaaaaaatagcatactagttct

SEQ ID NO: 4909 - DNA, 591 bp, Musa acuminata
  misc_feature (556)..(556): n = any nucleotide
taaaaataacaagtgcaaacagcgaggaatcagattcggcaagatacctgagcagtacggtgtctatcggagaaactattcatggaagtatatgatctaactgcgacagacttcatgtaaatatgatataaataaaaaaagaaaagaaaaaaaagacaacgttttaacaaacgttacagctcctcctacaaaagccggccaaatctgcagttccaaccatgtactctggattctttgtgcactctccaagtgcagcccacctctcgcaactttcgttctcgtctgtacagtttccttgacttgtgataatcttgtcaaaggaggctacgtgaatccactttgtggccgaccatttctcaccttctatcactggggcaccctgcgtgaaggctgccttgatctgtagtagcatctggatgaaggctgaagaacagaagagcattccctcgcttcggcttaactgcttttcctcgctgggcacattgctgaaaagctatcatccttggcatcttcaccacggtgccgaggttcctcagctgaaggaaacacagttcancacctttgggcagtctgttagtacataagacagta

SEQ ID NO: 4910 - DNA, 553 bp, Musa acuminata
  misc_feature (18)..(18): n = any nucleotide
  misc_feature (20)..(20): n = any nucleotide
  misc_feature (48)..(48): n = any nucleotide
  misc_feature (524)..(525): n = any nucleotide
  misc_feature (527)..(527): n = any nucleotide
  misc_feature (530)..(530): n = any nucleotide
  misc_feature (545)..(545): n = any nucleotide
ggtcttttatctttcctnangggattggtgtagggtttctttgttgtnaccggttaatcggactaaagattcgagggttgctcggatttgtgggagaatgggagggaagcttgtgtggctccgggtggtgtgggtttcggttcttctttggggatcttgttgggggaagttcgtggtggagaagaacagcttgaaggtgacctcgccggattcgttgaagggcatctacgagtgcgcaattggaaacttcggggttcctcagtacggtgggactatggtggggatcgtggcgtaccccaaggccaatcggaagggttgccagagcttcgacaatttcgacatctcttataaatccaaaccaggagggttccccacctttcttcttgtcgacagagggggtgagtcttaatgttatgagccctagaaaaaaaatcgtgtgtgttttatctatgtgtttggactctttcaaatcttgtcaaatgtagtgatttttctttgtgtgcatgcatcttcttttactgttnncntcnttgatttgtaatgcntaaatatt

SEQ ID NO: 4911 - DNA, 618 bp, Musa acuminata
  misc_feature (607)..(609): n = any nucleotide
aagtagagagtccattattctttgtaatttgaagcctacttttacatatgactgacacattatgccaaaatcttaagtaacaagatttttcacgctgaactaactgcaggacgaaattactgtgtttgagcaactcgaaggacttacaattcatctttgacatccgcaccgccactgttctcaccagcagaagcagatccatcagaggcctcagttttcaggactgatgccggcctctggagcttgaatgggatcgatgcatgcttcttaatgaaattgtagaacgccttcactgttctatctgcatccactgtgatcggttcaaaactcttgtttccagctggaaagaaaagaagtgtagggaaaccatcagccttggcccgagggtgctcatttgtggtaccatccattttcgctatcaccagagactcaatgccccgaagatgtttggcaagcttgttgtatgttggctctaatgcttggcaatgcccacaccatggtgcatatatctcaagaagaacatcctttgattcatccaaaacaatctcatcaaaattatttccaacaatgattttcacatccccatcatttgtctcaggtaacggannngaaatgtag

SEQ ID NO: 4912 - DNA, 546 bp, Musa acuminata
  misc_feature (5)..(5): n = any nucleotide
  misc_feature (448)..(448): n = any nucleotide
  misc_feature (470)..(470): n = any nucleotide
  misc_feature (482)..(482): n = any nucleotide
aatgncaaaacatattatctagcaaactcgatagggaacatgaggttcaactctgaaggaagagatttgttcttgataaagcaataaaaactaaatgccatacatagttaatactaccgagaaaacatcccataacccaagtggaaaataagtaccaattgctagagaatcaagggagacaaagctgctctcaagtattggtggctctagtgtagatttgttggcttgcatgagcagacaccatccgaatagcaccccttgccataagatcctttatggccctccttgctagtgatccattaatccgcaatcgctcggacagcacggaaggggtaatctgcttgtacttgggaacttcagacagcatcttatcgtagttcgcctggtcaaagaggaccgcgttgtttaccttctccttctgcttccccttgctccacttcttcttctnctgcttgcctccaccagatttngccggcttcgangacggggcggaccttgtccttcttgggcgccatctccctggatccaaacgcggagaagaaagac

SEQ ID NO: 4913 - DNA, 561 bp, Musa acuminata
  misc_feature (555)..(555): n = any nucleotide
tcagatcaaacgaagacgaacaggaaaaagagatcatatgatcgagaagcagaacctcgcaagcctcatctttgaacaagtatgagtggtataactaagatattaagtggaatctaagcgtaggtgatagatagcaagcaaagataaggctgtggcttagtgtgcttgctatgcccttaaacccctaccaaaccccttccaccgatcacgatcgagctgtgtcctcagtctttgagcttgaaggatgatccggtggcgtcaggcttgcatggctgagcctcgatcaggagctggaccacctcgttcatggttggacgaagagttgggttgctgcaggtgcagcgaatggcgatcctgagtacctgcaccagctcctctttcattgggttccatgagatctgcttgtccagtacctccattgcaccttccttggtgcacatcttgctcgatacccagtggatgatgtctctgctctccccgaactccggctcgatcggcttctttcctgtgaccagctccatcagcaccacaccgaagctgtacacatcgcacttngtagtg

SEQ ID NO: 4914 - DNA, 497 bp, Musa acuminata
  misc_feature (16)..(16): n = any nucleotide
  misc_feature (180)..(180): n = any nucleotide
  misc_feature (341)..(341): n = any nucleotide
  misc_feature (460)..(460): n = any nucleotide
  misc_feature (487)..(487): n = any nucleotide
taaactcacataagtnaacattcatgtccacatagcttcacaacatttgtgacgcatggatcaaattcatgggaacagttcaattagggtgcaataagcaaaacttagctgtataaggagtgcatggtaatgttagtacaacaacattttcgactgaaggtgataatatatatatctctnacgtgctgttatgttactcatttgcgatgtctatatagcctatttgatcccaactaaggagaagaggggaaaccttcactcggaagccactagagttcacctgtgatcacttgaagctcttggtttccccttgcttatggaattcaggtgttgggagacgnaaatgactacaataacaacgatcaagcaacctacaagggtgctgaaaaagagcgctccaggctgcctggtctgtacatatccataaaccccaccagaagttaccagaataatgtcagtnaggccgtcattggagaagtcttctaanaccaaggcgt

SEQ ID NO: 4915 - DNA, 555 bp, Musa acuminata
tcttatctgtacctttatcccatagattcagtgatctgtgaacatagatttgtccgaaccaagtgagaggaagctaaccttagtttccactacctagactttctttgtgtatgtctatataggagcaaattaacagttagacaaaaaaaggcaattacattaatattctactaatacaaaaaaatatatatcgaatgatctggaactaatttcatttcttggggaattccagctgataactcccacctcgagtgtggaaattgtaggcgtcgatcgctctacgatgacaatgagatctcatcctcgtcagagccttctggtctcaatgcatgaaacctcgggaacacaggtggtagggttgggttcaccggcaccggaaactgctgtgccaaactgatgatggtgcgttcgtttatccttccgacctccttgcagacacgatcaagcacgggccagaaaatctctgaccaccatgaaaatcctgaagggatgtgcttcttccttggcggagttaccatggaaatactcggttatctccttcaacaagagacaagt

SEQ ID NO: 4916 - DNA, 517 bp, Musa acuminata
  misc_feature (5)..(5): n = any nucleotide
  misc_feature (16)..(16): n = any nucleotide
  misc_feature (23)..(23): n = any nucleotide
  misc_feature (26)..(26): n = any nucleotide
  misc_feature (48)..(48): n = any nucleotide
  misc_feature (101)..(101): n = any nucleotide
  misc_feature (115)..(115): n = any nucleotide
  misc_feature (167)..(167): n = any nucleotide
  misc_feature (209)..(209): n = any nucleotide
  misc_feature (326)..(326): n = any nucleotide
  misc_feature (394)..(394): n = any nucleotide
  misc_feature (466)..(466): n = any nucleotide
  misc_feature (479)..(479): n = any nucleotide
  misc_feature (492)..(492): n = any nucleotide
  misc_feature (497)..(497): n = any nucleotide
  misc_feature (504)..(505): n = any nucleotide
acttntactttttaangatcgancangcgaaacgatttcacataggcntaaacttaatttcatccaaaattatcaactaatagaagaaaaaacaaggctangtcgacaaaacctnacaactaacaccactaaacgccaagatagcatatggtagggttgacagtggngtcatactattatctgactcagatactgtcatgagagaatcntaagctaatcataactataagctcagaattgcaagtgtcatagggaagagtagtttgccatggcgagagaggaagcagccagagtcattgaagctggggagggctcttcttggccangtggtgcttgttgttgtgcatccacaccttgaggactctccttctgactccaatctcctggcagagtngctgcactgcactctccgtcctgcttctgaagcctccagccgaccttctcagcgaacgacgagcatcttctncttctgctccggngtgaacttggtcntcagnctcttcnngaccagaatcgg

SEQ ID NO: 4917 - DNA, 609 bp, Musa acuminata
  misc_feature (604)..(604): n = any nucleotide
aaaaatctggatttaagtttcaatcgatgtagaattgattgtttatttgtccccaaagtacagtaaagatgattgattctctgaggggagagagagaattatgtctccgtggttgcaggattatgtctccgttcagcaatcacagaggtggatttcctctgcttttggatgatccaacgtcgtcttgccacaacagatgcatttccgcgtcgtcgtctcgtccgacatcgttcccgcttccatggggcgccaatctgcgtgaagagccgtcttcctcctcctgaggacgccgcaactccgcgtggccgcttcatgagcctgctcagtgccctgagctccaccgccaactccttcatggtcggcctctccgacgattccagggccacgcaagtcttcgcgacctgagctatcgccagcaactgcatcgccccggcctcctccaccagcctcgcatccaccagattaagaaggttgttctccttcaggtacgtgtagaaatgtgccaccaggttcctcgccgtctccgatctgcaaaacgatatcggcttctccgaagtcagcagcttccagcagaaccaccccgaagctatacacgtcgctcttnttcgt

SEQ ID NO: 4918 - DNA, 460 bp, Musa acuminata
ctgaataacttaaaattcaaattcttttacagaagtttcaggaaaactgggccagaagttcaacaagtgaagcatcgatttccacgaggaatcacaacatgaccattgaacatcttaataagctacgtacaggtgtcatccaacgtgctcataaagccacctataaaaccagcgccattgcagtttccacataagatgtccttcttacctctgcaaagccaacacagtgctccagctttaaattgcccattgaagtgatcgacagaattcacaccagtgcctttgcattgtgtgcacaattttgcaccattcccctcacaatcagcacatatgaggcttttcagtttcgtggccttattagaatcactctctgtagccttagccttattagaatcactctctgtggccttagccttgagagattgaaagctagggttgacaccacgggagatggggtttg

SEQ ID NO: 4919 - DNA, 529 bp, Musa acuminata
  misc_feature (491)..(492): n = any nucleotide
  misc_feature (503)..(503): n = any nucleotide
aatggttcttcatcttatgaacacaatataaagatcaaacagaagcaacaacatgaattgacagagaggtgtgaaaataaaacaagcaggcaatcacctccatgttcagcagaactttgtcttgtcatgtgttcgttacacatcagtagcacacagcgaaagagaaaaacacaaaagtttgttgttttttatatttatctaataagagtgggaagactacatcaccagggaggagtagatccctgtcttgttgaaggagatcttgatcctaagctcccatcccttgaaaaccttgtcttctcttttggggtgcttgcgaatgggctagacccacgatagctagctcgaagagtctcatccacagagcgagaagacttggcaatggcattcctaacaaacttctgagcagctggagaaagtgttcgcacacttgggctggcactgcctcctcttgctggtgatggcaatggtggcttttgaaacatcttagnnctctctctcancttacgtgcagcttccctcgccaacg

SEQ ID NO: 4920 - DNA, 812 bp, Musa acuminata
  misc_feature (25)..(25): n = any nucleotide
  misc_feature (27)..(27): n = any nucleotide
  misc_feature (85)..(85): n = any nucleotide
  misc_feature (112)..(112): n = any nucleotide
  misc_feature (119)..(119): n = any nucleotide
  misc_feature (136)..(136): n = any nucleotide
  misc_feature (158)..(158): n = any nucleotide
  misc_feature (171)..(171): n = any nucleotide
ggttgaaatcgatgcagtacaactngntcaaggttgatcccctcctggatttatctcagcccctattgttatagaattgaatgcngagaaattttccataggcagcatatgnagttttncaaaacacacaattaancattccagattcataaagctgnctccctacacatntgaggggatatctactgagatacatttggatcttgatgaatcatctgacataggtaacatggttgccaaatatatgctccagcaacctctgcaaccaagagacaacttccagcgatctattttagttcatcaaaagtgtgacgttataaatctctcttcttgaaggaggcacaagtggctgacaagaagatgtgattttttcagcgcaaggggtttgcttccttccatagattaccaaccatttcaagtgatgctgactgtattagctacggaatggggactgattgtcaaaaggcagctcaataggtgtagcgttgccataaaattcttccaagttgtaataagctcgctgctgcggaagaaatatatgaactaccacatcaccaaagtctagtaaggtccatgagttgggcttggtatcaccagatgcaattttgttaaattgcttttcagctgtgtctcgtatctttgacccaattgcgtcaatttgcggtcgagaaaaggctgtgacgatgataaaaaatcgagtccagtaaaccagaggcttcacaaagagaacacggatatcagcagctttgacctcatttgcaactttgggctagtgtgaccgcaaaagacaagctctcggaatcatcatctgg

SEQ ID NO: 4921 - DNA, 705 bp, Musa acuminata
ttgtttaaatctataaatattagtaatacaacatcataccccattaagcaaaaaagcgtaccttgggatcaaacaagcggcagcacacatgaagaacatacaaagagtcttaagcggcgctgcaagatataaaccaagtatctacctgacactacaggaaaactagatcatgggcaaatctgcacaaggcatagtgtcttaggatacattatacatcaattaagacaacatttgtgttgtcaagcaagatttgttttcttgttatatagtctaatacttcccccattccggtaatgtcttactgcctcaagctctcaatgatataggaagcatagagatccattgagtattcaattgctttgatggcatcttccgctggcaggaagtcatttactgcaacctccttgttctcgttcttcttgtagtcttcaaagaagcggcggatttctgcaagacgatgaggtggcatatcattgatgtccttgtaatggcgaaactcagggtcatcagcacaaacggctattatcttgtcatccttctccccctgatcaatcattggcatcaacccaatagcacgagcacgcagaaaacaaccaggaccacctgctcctgcatcagtaccagtacatccatgggtcaccatcctcacagagggttcgagggatgaaaccatagttgtgtggataaaccactgaagagtagaga

SEQ ID NO: 4922 - DNA, 1179 bp, Musa acuminata
  misc_feature (5)..(6): n = any nucleotide
  misc_feature (9)..(9): n = any nucleotide
  misc_feature (12)..(12): n = any nucleotide
  misc_feature (14)..(14): n = any nucleotide
  misc_feature (580)..(580): n = any nucleotide
  misc_feature (1169)..(1169): n = any nucleotide
  misc_feature (1173)..(1173): n = any nucleotide
acccnnccngcnanagagaactttaatttgcatctgagaaaataatcagaaatgcaacgagcagatacagtagcgtcagaggtcagtttgacagatggaaaggcttcgagagatcgatcaccttcacagaaatgtaggaactctagcatccattgcttacagatgtagaacccatacagtcgagttgagaaaacaacaatagaaatacaagcagaatcacaacatgtatagaagaagatcactgagattctaaacagcattcagaagctctacacttgccctaaatacgataagaattccagttttgaaagctcactagaagaaatcaaattccaggtagttatcagaacctttctcagaggtgaggctggccttctggcttgctgatgctgcagtccctaggggccgagcgatttcgaagggcttggggatctcgggaggacttgcacatcttatcaaggcccagttgataccctcaaagaacgggtgttgctttatctctgtagccccacgtttataagcaagccggtgttgcggatctttgacaagcaatcccctaatgagatccctggcagcgaanttaacgactggaaactctgaaaatcgcaatggttgacccaccacattgaacagtgtagcacggttgcctgagcccttgaagggtgtcttcccgaacaaaagctcatacaggaagatgccaaacgtccaccaatccactgcactaccatgcccctctcccttgatgatctcaggggccaagtactcatgggtaccaacgaatgacatagaccttgcatctgtaggctctgcaacgagttcagggagtgcgctgacctggtttccagtatcacacttctgtttctgatgtttcttggactttgaggaaaaaagccgaggggagaagcatgttgttgggaccacacaagaaggttggacacaggatggttcgatacacgcaggctgaacacagtaaacagggttgtttcttctgaaggactcagagttggggttggaggatttgacgagggtggggttaacagcacaacggagggagaggtcaaagtcagagagcatgatgtggccatcttctcggacaaggacattctctggcttcaggtcacgatagataatgcccagcatgtgcaggtattctagagccaaggaggacntccngctatg

SEQ ID NO: 4923 - DNA, 504 bp, Musa acuminata
  misc_feature (13)..(13): n = any nucleotide
  misc_feature (489)..(489): n = any nucleotide
tgaaatgttaaanattcttcttcacttgagttgttgagaaaaagaaatattttgcaacagtgaagaaagtggataaaagaaacgaagccaactttacacttcaagaaatcttagtctttaacaagcagtcataaaagaaggctatatgatggcatgtcttctatcctcattacatcatccatcagaagctccctctccagctgcgcacgagtcgacttcagaacttcattaaattccatgtaagaagcatttctctctagccattgcttgtccatgaccatgaaagctacacagtaaagcaagtcgaatgcccattcatcctctgacagcatttggatgaaaacagctctgacaaatgtccttgcttttgtggactgcagatctaacatttgcataatcatgaaagtgatattcacaccagcaactgcaaatgggtattcccatgtggcccgcttcccacattgtttatttagcaacctctggaagggnttagagaatgttttt

SEQ ID NO: 4924 - DNA, 650 bp, Musa acuminata
  misc_feature (635)..(635): n = any nucleotide
  misc_feature (647)..(647): n = any nucleotide
gggttgttttttcacatgataggttacaggtgattagtgcatagaattttaagcagtaggcaacaggttacatgatttattacatggcagagtaaaatttcaatctggttgtttgaatatatctccactatcttcgcctaaggtaggaaaagataactagcatcgacaacaagagaagtgaacttacatgtatgattatgtagttcatggaatatttacgaagcaactccatatgggagaagggcagcagccactggccttccttcttcgcttaatatattgtaagttgaagcagcattcctcgagtcaattgcttccagtttcattccagtagaacgaatgaattgtcgcagttgagggcttactggctgaatgtgccttccacagccaagaatcagaatctctggaactggcctcagaatcttgaatactgataaactttcaggggttatctcagaaaatgtttttggtacccatgtcatgagcttattttccacaacaagcaagctgccttcatacttgacaccattgacagtaaatcctgtatcgccatacccatggaaacgcaattggtcttcaggcacggtgtcgatgagattaatctgatcatacagagagaacgtgcgctaaggganggtagggttcgnttt

SEQ ID NO: 4925 - DNA, 624 bp, Musa acuminata
  misc_feature (603)..(603): n = any nucleotide
ccaaattgtgacttaaaaatggaatagatctcaaacagaagacaatggaagatggctctggaaaaccctcctgaaaccagagtttacttgcctgttaaaaacattgataagctaaaggtataatgtcataagataactaaataaaccaatttatggctctgcgattgttacttcgacctccacaccaggttcaatggtgatcgaggttatctgcttcacaacctcagaagaactgacaagatcaatcaccctcttgtgcacgcgtagttcaaaccgatcccatgtattggttccttcaccacagggagatttcctggtggtaatgtggaggaccttggtgggcatcctcacgggacccttgacggtcagccgcttgtccttcgctcccctcaccagatctgcacaaaccttttcaaggttcttgacgttcttggaggagagggtgatccggatgcggtgaagctgctcctggggttcttccagccccagcttcgtcggtttcatcgctccgtaagccgccgccgccgccatggtttcgatgctgaacaaaccgaagcaaagacctaacactagaaatcgtcaaatcgagatggagggcctgancgaatagatgatacgtgaagg

SEQ ID NO: 4926 - DNA, 619 bp, Musa acuminata
  misc_feature (4)..(4): n = any nucleotide
  misc_feature (17)..(17): n = any nucleotide
  misc_feature (38)..(38): n = any nucleotide
tgtnaaaaatacatttnggacaataaataaaccaagcngtaattgctagagtttataaaagaaaatatcccaatcatatcactcactgtcccaggaacataatttaatttcttcactccagaaaacccgatcaagcacagggtgaaaattggtacaactcatggatgatcgccaatgtctgatcataacacatttatttgacagtccaaagaggctttatgctagtcttgctcaaagaacctccaactaactgtaaatgagtatagctagtagtttaattccattttgaactcaccgaagctatgcatgctttaacaactccactatctccgtgacttcttcggcctaatacgacgcagagccatatatgtcacagccgctgagagggagtaccatgtaaatgtataattcaagtggtcttgaggcatgactgaatgacggatcaaggtgttgacatcttttgggattggataaggattgcttgcgctgacatcttcattgatgtcttcaatataaagagtattatctgggacaccacatgctcgagcaatcattgcaacatcgacataaaaccactgaccagtgctgggatcattctccgggaaccaatatgctaggt

SEQ ID NO: 4927 - DNA, 554 bp, Musa acuminata
caacgctagtccattattttattcacaaaatatcatagtccattctcgaaacaaaacgcatgacaacctgcgatcgcacgacacgatagttaaagtcgcgattggagggacacacactcacgaccccttattcacgctaacacacagcaaacattcaaccggagatctcgatggacttgacattgggcttcttgaccccctccttgggcacggtgacggtgagcacgccgtcctccatggccgccttcacctgctccaccttggcgttctcggggagccggaacctccggaggaacctgccgctgctccgctcgacgcggtgccaggtgtcggtcttctcctcgtgctcgcggctccgctcgccgctgatctggaggacgcggccgtcctccacctccaccttgacctcctctttcctcagccccggaaggtcggccttgaacacgtgcgcctccggagtctccttccagtcgatgcgagtgtcagcggcgaaaagccgagggctgcgccggcgtaggaagaggttgggaaggggatccggggaacgagaggtt

SEQ ID NO: 4928 - DNA, 590 bp, Musa acuminata
  misc_feature (292)..(292): n = any nucleotide
  misc_feature (375)..(375): n = any nucleotide
  misc_feature (497)..(497): n = any nucleotide
  misc_feature (503)..(503): n = any nucleotide
  misc_feature (515)..(515): n = any nucleotide
  misc_feature (538)..(538): n = any nucleotide
  misc_feature (567)..(567): n = any nucleotide
agtattgtcataagctcctttcatgatcataatagttgggaagcatcttcagtagaatcttaagttcatattttctgagagtctttattacaaatctctcatcttgtgatagataaaatatgcttccacttttccctggagaagaaagctccttgaggccatcacctccacatattgacatcatatagtcagcggcatctatcttaaacatttcacgaaggttcctaaaaaccattgggcagtagtccttccaaaagaaaccaatagaactgtgtggaggtgtaaattgagntcctttgctagggaagtacattcgtattctagctcgagtcccaaaatcagaggaacgtacttcacgcataggcacaggtgtgnttttcccaactgtatacctaattccaagctgcaagtttagcatgagatagtagcttctgtggcctttataaattgtttcaccaggtccccttggttgtttcttcatcttgcagtgccatttnttcttntgtgatcttctnaagtcataatatctcatgccttnctgttatcagaactccttgcatgtactcnctatcataaaactaaaacactgt

SEQ ID NO: 4929 - DNA, 761 bp, Musa acuminata
  misc_feature (54)..(54): n = any nucleotide
  misc_feature (119)..(119): n = any nucleotide
  misc_feature (724)..(724): n = any nucleotide
tttgtacactcgggcactcttaaccccacttcacctaatcctggatgctctggntttcacccatcattatccgattgctgaccacgttaaaccctaagatcgatgcactcaccttctgncctttcttcccctttttcttcactcgtcctttggatggcccgtctagcccttcttctggcaccatcagcttcagtggcagctgtcgtgttagaattgcgatgactcgcactcccagtggatgggttatggggcttctgcaactggaaggcaatttcgaggacatctgatggcaaaaactccttgtagttgaggaacttgtcgatgaactcatgattcgggtccattgaaccgagattctccctcagtagcatttcagcctccgaagttgattgcttgatgcaaaattccagaaaacttgtatcattagtccccgtgagacggatccactcattcacacaccaatccctaaattccattgcttcttttgaaactgatggactggggctagaaaaggatgaaagagactgatccactggtctgcttcctgatggtttccgacctgatcctgctccagaagctcctttcgaagtggttcccttaattccccagctaccagagcttttgggatttggtttggtttgatcaagaggcccccaaaacagatcatcttcatctctagatttctgagctggaacttgtgaaatgagctgaatggatgatgcantgttggatggagatgatccaaataactgcctagaagt

SEQ ID NO: 4930 - DNA, 612 bp, Musa acuminata
  misc_feature (12)..(12): n = any nucleotide
  misc_feature (457)..(457): n = any nucleotide
  misc_feature (488)..(488): n = any nucleotide
  misc_feature (530)..(531): n = any nucleotide
  misc_feature (547)..(547): n = any nucleotide
  misc_feature (553)..(553): n = any nucleotide
acatcatatttnaaccagttccacagtagcgtggataagtagcataattagttatgtgataattggcataactaacaggcagtcatttgagaaagcaaactcattgagccaggcactgaatgagcgaaacaaggtcaaagtgacatgtgtatccgtttgatgtaaagcaattccatattcacaagaaaggagcaagagaacctcgaagaaaattccaaggttataggaccctaagctgtgcaaggaaggaagcacataggtcgagaaagaggagctgcggcccactcaccctctgcaagtcgaggagatacttctcttccctggtcttgtagagctggatttcaaacttgatcgtgctgaattctttcccagaaacattgtcactttcaacaatggcagattcatcgctaacactatggttagcatgcagggaatcattgaacatgctctctgcatnatcagaaatgccaaaaaaatatcggcatttnatgttataatgtccaatctttttccaacaaacatttagttcnngtagagctttaagganctccgncattatttcacgaggatgagctcgagactgaagtccaagagcccattttttctcaacag

SEQ ID NO: 4931 - DNA, 411 bp, Musa acuminata
ctactcaagatcatacatctcaattgccacaaactattttatcccaatcttttgatgaaaactcatcaccaacaaattattttttttctacacttgtacacgactgaataagctgttttgagcaaatcatcatctaaggtcaccattatcttgatcaggggaacgacatgaaggatttagggcatgcaatgtaaatcttctcaaactcgctgtcacatgaatagagcctctcaggttgcgtttcgattcactttgaggtacggtagtgcaccaatgacattgtcgtagtcactcttgtttactggatgcatcttggacagccggagcttcctcttggtgttcttcttcgccagcaagtgctgcttccccgcccgcctcctcacaatcttcccccgccccgttacccggaac

SEQ ID NO: 4932 - DNA, 417 bp, Musa acuminata
tatataggttaaagtacagtgtccacagtatagaaggtttcacaaaagaacaatagtatcaagaggcataaaggttttcaacaggagcataccaacatcctcacatacggatatcctcgcgcaggaggaacagagactttgccacgcaatgttagccttcagtcggcagtccagctttgctccactatctcacgaactctccgattgtattcacgcttgttctcgctgaacatacgagcagcctcagaattcgcaggagagtttgggttcgggtcgcagaggagcgactgaatagaagtcaatattgcagcaacatcatagattggactccattgattctgtaaaatatccaggcaaatgcttccatctgcataaatgtttggatgaaacattcgtgagacaaaccgcacagttggg

SEQ ID NO: 4933 - DNA, 625 bp, Musa acuminata
  misc_feature (607)..(607): n = any nucleotide
gactcggtcaacgtaaccccaatattattcaaatataattgaattgacgagttggaatcctattgttcctttgtcatagtaaaagatgccggatcggatcggagtccaacccggatccgaaaggaacaaccacaaacgacaagacaaagtatcgatgcgatctactcgctctccacggtctcgtccacgccactgccttcgtctgccttggccgccgctccccgggccatttccagtgcctgaatcaagccctcgaggcgcgaaccggcatcgtccttcacggacttggtcatcaggttctccgccacgtccgccggcgtcatcttcacctcctccatcagccccttgatggtgtcgaacagcgggtgcgagtcgatgtccaggtagtttttggccagcacaatgaacgcctcgaaatggcagtaggacagctcgatgtgcttgtccatcctccccctccgtatcagcgccgggtccagcttctccacgtggttggtggtgaagattatgagccgctcccccgccgcaggcgaccacaggccgtcgatgaagttgagcagcccggagagcgtaccttgctctcctccttgtcctcttctcccccggnacttcggttgtcgtcgct

SEQ ID NO: 4934 - DNA, 603 bp, Musa acuminata
acatgttataatagatcattaaagcaatacaaaagagtagaattctagcaattcaaaatttcaaacaacctttggctggatctgctcaaaatcaaacacctcaaacatcaaacgcctgacatctggtttaccatagacagtgtatgcaagaccatgtatcgcttgctgtactgcagttgtggccggatttctcagccttcggttatgctcgtacttgtcttgtgctagctcaccatagatgatgaaatggtgaagatgcttatccctcaagtatcggccacagaatttgttcatcagcgttcgccggtgcttctcttgtaaccatctaccaggggcatcaagatgcttcattagtaatctctcagccatcacaagatcctgaatcttctggccaacgtattccaaccgctcaaaacaaaatcgaggatgctcaaacttgtatttagaagaatgtagaaagcacaactgaagaccaaggccaagttcaatattcctggcctcagtgattctgcaattcgtcactcatgggcaaaggatagcccagtgtttccataactttgggtctgtatcaaagtcccagatattcctcgaaccgtgcatgct

SEQ ID NO: 4935 - DNA, 592 bp, Musa acuminata
  misc_feature (15)..(15): n = any nucleotide
  misc_feature (32)..(32): n = any nucleotide
  misc_feature (514)..(514): n = any nucleotide
  misc_feature (579)..(579): n = any nucleotide
ctgcataatatattncatttttttaatatctnatcccagaagaattgcctcttaacagtaatagtcacatgaaaccaaatttggaagttcattaacataatctcactggaataagtaaagctataactcagtctacttaactagtttcttcaacacatcctcagcacgtttttccagcttgggcagtgcccaatcgtgctgaatgatgtcaatgctatccttctccgcacccaagctctttgttggatcaaaaccaaatccgctcatttgcatcatccgctgcgtgtcgtccatagcattctcttcacccagaattaggctgaataaaccccttagtccaaacaaatttagaaagtaccaggaacgactgctgacatagctcacatcgacagtgcttaaatcgattccattctgcagcattcccctaaatctatgggtcaagggaaatggtatttttgctgccacaaaaccagagaagaaaaagttcacccatgcaaatgtaagtgtctgtggnatgatcattgaaaggttcttcttcatcatatccatagctaagtttgggtctgaaaacatctgagnctgtgcattttga

SEQ ID NO: 4936 - DNA, 522 bp, Musa acuminata
  misc_feature (13)..(14): n = any nucleotide
  misc_feature (18)..(20): n = any nucleotide
  misc_feature (441)..(441): n = any nucleotide
gatattgtattgnntaannngtgttggaacacatacttattacaacaaaatcaaagtaaacagtgccatatgcatcagatacatacagctctactgtctgcaaacatatatcacaaaaatagaccagtatatgttgttgactgctcagtaatattcgagatcagttatcaaagaaaagaatgaaaaccaaaatttgtaatgaccatgaacaagtagtcttcatatttggagggtgcatatggtaccacccatgtcctaaataatgtgctcgatcactggaacttcgaggaacgccagtcatttgaccataaaggagcttttacaactgcacccccccactgcacttggatttgttaccacctggaatgctgaacggatcaattcctcgacataatcaacagtggaacctttgacaaagtcataggagatgttgtccaccancaacttcacaccatccttctcaaaaaccctatcatctgcgtttttcttgtcatcatgcaaaagacatactggaacccagag

SEQ ID NO: 4937 - DNA, 779 bp, Musa acuminata
  misc_feature (5)..(5): n = any nucleotide
  misc_feature (9)..(9): n = any nucleotide
  misc_feature (11)..(11): n = any nucleotide
  misc_feature (54)..(54): n = any nucleotide
  misc_feature (58)..(58): n = any nucleotide
  misc_feature (295)..(295): n = any nucleotide
  misc_feature (301)..(301): n = any nucleotide
  misc_feature (398)..(398): n = any nucleotide
  misc_feature (454)..(454): n = any nucleotide
  misc_feature (477)..(477): n = any nucleotide
  misc_feature (484)..(484): n = any nucleotide
  misc_feature (502)..(502): n = any nucleotide
  misc_feature (545)..(545): n = any nucleotide
  misc_feature (606)..(606): n = any nucleotide
  misc_feature (615)..(615): n = any nucleotide
  misc_feature (627)..(627): n = any nucleotide
  misc_feature (642)..(642): n = any nucleotide
  misc_feature (644)..(644): n = any nucleotide
  misc_feature (670)..(670): n = any nucleotide
  misc_feature (711)..(711): n = any nucleotide
  misc_feature (718)..(718): n = any nucleotide
  misc_feature (738)..(738): n = any nucleotide
  misc_feature (743)..(743): n = any nucleotide
  misc_feature (772)..(772): n = any nucleotide
cggcntcantnactctgaatcaattctcaatacattcctcgtctttaatttgcngganactcctatttctactgacgcatcttggcgatctccagcagcttctccgtctccggcatcacctccttcacggcctcgtgggcgcagaacctctccgcccaaaccgcgagcagaggtgtcttctcctcgtcgaacaacttgaggccggtcatctgctcgatcacattcgcccatcccaggtaggcaccgagagcgatgtcgacgtaaccgatggtgtccccgccgaagaaggctttgnccttgntcagcttctcaaacgcctcctcgagcagcttcagcccggcccacgcttgctctgcggattcggccttggcctcctctgtttcagcctttccgatgcngaatattgacgggaaccacttgtcgtcgatgtagacggaccagaagcggtggaggncgcgctcgtaggggtcggcaggnaagatgncctggccggaattagccnagaccccgtcgacgtactccacgatgatcatcgactcgcagangggcttgtcgtggtggaggaggacggggatcttcttgtacacagggttggatctgagaagnagctcgctnttctccccgaanttctcctgcaggaantngtactccacccccttcaggttgaggncgaccctcgggcgcagcacgaacgggctcggccacgccccnatcagcntcacttctcctgccgccgcngccantgccttgttcttcttctcccttcttcggntctcttt

SEQ ID NO: 4938 - DNA, 648 bp, Musa acuminata
  misc_feature (9)..(9): n = any nucleotide
  misc_feature (47)..(47): n = any nucleotide
taggttctngatttgatgatggttcaaacaatgctattctctcgganactcttccgaaaagattccatgttactacaggagaaagaaacgtgttacatatttacatgcgtgaatactttgctctctctcgctcctccatccctatccgatctctttattccaaattcttctcgtggaggtatccatcaatcctgctgtcagtggaggccggcctgaccgtcatttggcttggcatgccgccgagcaagaagacgtcatccatctccaaaccagtggcatagttgtggaggctctgacgaagaaacgcgtcatgctgcaggctgctgccgttgctcctgtcgagcctaaacggcgtctgggtgtactgatactgctgaggatgacgacgatgatggtgatgttgatgaggttcgtactggtgctcgaggtatgtaggctgcagtaggtgccccggcggcgccacggtcgtctgcgggtcactgaagtcgaggccgaaaccgggacggtagctggaagagtacggcccagacgggaacccggtgaactgctgcaccatggctcggaaattggaggtgtcggtataagcaggtgaccggggctctccgggaggtctcgtccgccgccgggccggctcacactcggctctcg

SEQ ID NO: 4939 - DNA, 401 bp, Musa acuminata
ctctctctcacacacacaaacatacattatttcatacattgtctacaaggagacttatttatgttcgaacaaatttactcagacgagcattttgatgcaagagctgattcgatttaccaaaaaacggccccatggaagtgactgcaactgcaaacaagtccacccatcagttcgtggagaaggctcggagagtttcatccagtgctctctggtcatagtcaccggtgaagacacagctacccaatggacccttcaaaaggatcaacctcagcaatccatcagccaccttcttatccactgccatgacagatttaaatttctccacagtcatcatctcggggggttgagttggaagcttggccttctgcaggatgctaaaaacacgcttcacaatagtatca

SEQ ID NO: 4940 - DNA, 600 bp, Musa acuminata
  misc_feature (7)..(7): n = any nucleotide
  misc_feature (12)..(12): n = any nucleotide
  misc_feature (571)..(571): n = any nucleotide
atgtacnattcntaccaatgttaatacatggagtttccgaatacgagcagaggaccctcccctatgtagataggaggacacgggagtgtggacaaacagcttcctcatcaaatttttgtggctctcaagaacacgtggccgaataccaaggaggttggcacgtacaacatcgaaggcctagcttctaattcctgagcataattcggcatcaaataggtttttgctattgtacaaatcagaacagctggaaaaataagctcgtggaaccatcgccgaatgacctaaggtctgctggtttcaccaatgctctacacaacgggcatgtcctttctctctcaaaccattcagagacgcagtcctcgcagaagatgtgtttacagctgagtaggataggagcatgcatcttctcctggcaaatagcacacagatcgccagcagcaattacctgttccattgttgcataggagccataaagtacttctttccgtgatagtgccttcaatgcagcaacaaaggattgaacttctccacaactgaagtcagcttaaaggtaaggtatagtcctgtagtnggagagaaaagaggctccatattctttgt

SEQ ID NO: 4941 - DNA, 534 bp, Musa acuminata
  misc_feature (459)..(459): n = any nucleotide
aatgatttagttcagacaccaaagaaactatctcttacatgctttcatgtcatcgacatagctcattaaaacgaaaaggtcgcagcaagaaaattgatacacatcgatgtacatataataatactagaccctctgcgtgacaccaagggcactatggtaatttggtccgcctccgccatctaccgcttctagtcgtcggtgtcatcatccccgccgaagatggagaagcggtagtagaggaggaagaggatgagcagcaggaggagcgcgacgccgacgggggagcccccgacgcggtggatggagtcgggggagccggcggcgaatatgtccgagagaatggcgccacggtccgacgagaggaagcggatcaccagaacgaggaggacggggaggagcagcaaccccgcggggctcagcatgtcggagatggcccctgttatggttccccaaccccgncgacgaggaacggcgccgcaaccaacaacccaaccaacaacgccagcagaacaccatgaggtggactccccggac

SEQ ID NO: 4942 - DNA, 613 bp, Musa acuminata
  misc_feature (6)..(6): n = any nucleotide
  misc_feature (602)..(602): n = any nucleotide
catctnctatttttatccatttgattaattcaaatttagcttcttgcactcacattgtaaatattttccgccaagtccctcaccaaaatttgacgcgcacaagagttgtcagaataagagcaggcacacaacggcacagcacacaaggaagagccaaatctgatggagtgaccgtttcagctccatctcctgccttctgagcctgccgctgccgacgtcgccgcccatgtggtaaggactcgagtagtaaatgcctggccgctcttgattccggaacacccacgggagcaccgccatcaccaacccccccagcagcccgccggccgtagagtggatcaccctcgtcgctcccgacgtgtactcccacccgtgattagggtactggtggatgtgtggtggtacttggaaaagtgggcagaaatgttgctgctggcatgactggtggtttggcttatattcttgatgaggatgacacttcttattcccaaggtcaacaaggagatagtgaagattcagaggggtaaatgccccagcaggacaaatgcagctgaagagcttgatagaagctcacgtgaaaaaaactggtagtagtaaaggtgctngcaattttgag

SEQ ID NO: 4943 - DNA, 1067 bp, Musa acuminata
  misc_feature (50)..(50): n = any nucleotide
  misc_feature (60)..(61): n = any nucleotide
  misc_feature (72)..(72): n = any nucleotide
  misc_feature (99)..(99): n = any nucleotide
  misc_feature (115)..(115): n = any nucleotide
  misc_feature (612)..(612): n = any nucleotide
  misc_feature (1009)..(1009): n = any nucleotide
  misc_feature (1044)..(1044): n = any nucleotide
gatccagatgtcaatgaagatgatcttaaggaagctttttctcgctatgntgaggttccnnccgttaaaatncctgttggaaagcaatgtggttttgtnctttttgttcacgganataatgctgaagaagcaatgcaacagttaaatggtacaattattggcaagaaaacagttcgcctgtcttggggtcgcaaccctgcaaaaaagcagtcaagagctgaacgtggcaagcggtggaatggtgcttactatggagggcaggtgtatgatggatacagtttatctcctcactacccaggtatgtacgtattaccaccgtatggcgcttacgctttctacgatagccaacaacaagtgaactgagatacaaattactgccgactcaaaagggataaactcccagcattatagtagtggtcaatgtaggtcgtgaactagtcgaaaaccttgagttcaaactgaagttctttaagtttacacacatctgggttttcgactagttcacgacctacattgaccactactataatgctgggagtttatcccttttgagtcggcagtaatttgtatctcagttcacttgttgttggcttccgtagaaagcgtaaggcncatacggtggtaatacgtacatacctgggtagtgaggagataaactgtatccatcatacacctgccctccatagtaagcaccattccaccgcttgccacgttcagctcttgactgcttttttgcagggttgcgaccccaagacaggcgaactgtttgcttgccaataattgtaccatttaactgttgcattgcttcttcagcattatttctgtgaacaaaaagcacaaaaccacattgctttccaacaggaattttaacggaggcaacctcaccatagcgagaaaaagcttccttaagatcatcttcattgacatctggatcaagccctccaacaaatactgttgtattagctgaatccatgtctgtttgggagctgctgcagatgcaccatttggnccaaaaccaccagaaaaccttttaggtgtagcaanggccaacccgcataggcctcgtg

SEQ ID NO: 4944 - DNA, 780 bp, Musa acuminata
ttctaagccaatatataatttgctactgcaatttagttcaatatgtttcgttaaaataagtagctccatctcttgtattaccacaatattcaaaggaaccaaacaaccaaaagaacaagcgaccgaccttagtttgtagtggtcctcactgaacataggaacaaataacagcgaacacatgacaccgagacgagccccaccgagtgttctccacatctccaaactgagaatgtgtttctaaggccactcgtacgctccgagaaacaacgtaatctagttttatggatttgacatgagcacaaacttcctccttcggatgcatttcctaatgcgcagaatgtttccatcctccgaatgcttcctcgtcaaagcctcgagtttccactggcgtgaaagtgagaccgacttttatttctccacagtatcgctgatccttgaccacactgtatatggttggcgtgaggcttccttccacgaacactgcttccaatgggatttttgcttctcctacgaaatcatcttttgaaaaagtatcactgtccatgattttaacaatgagctccgagacattgtcagacacattaaagacaaaggtctcattccattcaggattactacctgcacctgatgcagtactgcttttctgttcctgactgcggtacgtaaggacggcataaggatccattttgccgaagaaatcgacgtcctcgaggcccttggcgctcacgagcagcacctccagcgttccacgaaccattctcgagctctcgaacgcgacga

SEQ ID NO: 4945 - DNA, 794 bp, Musa acuminata
aatgaatgatttcagtgaaaaaaagaagtttccatgacagagtagaaaacattccaggagcataactgctcttgattacaaatggaatgcaacaacaaacttctagagaagggatttaaaatgtcatacatgaagcaacttgatgccttgatgctaactggatgcctcttctttcttttcctttctttctttcacaacctttttccagttctctgtgctgtcgattatttcgccagttttgatgaggtagcggactctggttccgtcctcgaggattttgtgacccactctgctcgccacttctttttctttagagtaaagcatcacatttgagctgtggataggtgcttcaatcttgacaatctgcccaggttcaccttgttctctgctcttcatgtgctttgttttcaggttcaagccttttacaatcacagtgctgttatgcctgaaaatgcgagtaatttccccaattttaccgttctcatggcctgtgataagtttgactgtgtcccctaccttaacatgcattttatgcagtatgggaagactatttggtttacattccttgcgctcccagcgtttaagcctcattactatagtgcatggctggtccaccgatttaacgggcgtcgataggagtgggggagagaggcgctggcccaagaaggaattggaggagatggaaagggatgccatcgagctctgtagcgccaccatcgtcgccatcttcgagcgctcacttctgcgcttgggagttcggataaagcgcagaaggggtgagtgccacgcgtccg

SEQ ID NO: 4946 - DNA, 621 bp, Musa acuminata
tgtatccaagatatattacatgtggtggaatgatttattccagatgttcagcttgcttgtctgctatttagtacagaaaaaatatatctgatgccatacatactgttaagtatatctagaaataaacagtagaatgcctcaaaacagctatttgtagacatgcttagacttcaacaatgcatctcgctttccaaagtggatttcatgtttcaacctagtcttggggcttttccagctcctccatgaattctgttgtcatgacaagataatcctccaagtgcagtcgcttccattcctcaaaatcccactccccatacaagtttggatcatccttgttaccccagatatatgcatcaactattagtttctcagaattatcaaccaaagaaacctcaacagcccttctctcatattcgaggtcttcaaaggaatctaggacatctaactcttgatctgtgatgccccgtaaaacctctcctgcaacattcttacaatctatgggcaggattgctggataaacacgggccctttatactaaatctgtggtaattatggaggatggcaggggaggaggggggaactcgcttgagaagcacgcgcaccaacctcatctgccaatag

SEQ ID NO: 4947 - DNA, 537 bp, Musa acuminata
attactgcaatcttggcttcccaacatttggatgttaggatactaatttaagcttcaaattgaagctttgaagttatcagaaactactgaatattataaatcaatgacacacactgtctttgagaacacagtgcgatctcaaacaaacatgacccaatatccatggtttcgaacaagggttttattatcactttgagctgatcctcctgaaatgcttcactctgtttccggcctagtaaagaaattgttgattgctggcatgatctctgggtttttgttccggacgaatttacggagactatgctctgcatatttctctccctccgcatggttatccagcactcccgcagcccttccttccttgctaactctcacttccgggttgatgcagatgttgcggacaagctggaagccgcagatgcccaccgccaccccgaccgccgcaaacagcgggtagacctcgggcttaaccaacgtttaagggtggaagacgccatggaaacaggcgacggggctgaggaggagatgcgaagagcg

SEQ ID NO: 4948 - DNA, 669 bp, Musa acuminata
  misc_feature (629)..(629): n = any nucleotide
agcgcccagaagtcgttaccatcaggaagaacttgagtcttaaccacgatcttcttctaataaatatcaatagaatgtgactaagcaagcagaaaatataattaggatgcagaaacttaagggtacaaatcatagtaggctgagttgatgagggaggcaatcttgatggttatcagtcccctcttccatccggttgctagcatcacatttgagagaccaataaacttcatagaacttcccatttgagaaaaggatataacagactgttgatttttgcaagctgaccctcagcctcaaattgagatcgcaggcaccatcaaccaataacgtgattcagataaccctcctctgtcctccaaatgcccaaatctttagcttcttgtcccagctacctgtgcataaagcactaccatcagaagacaaatctaagcagcttatgcatccctcatgagaattctgaagttctcccaggttcagaaccacctcagccaacagtgtatcccacacataacaagcaccactggagtatccagcaaagagcagtcttcctgatatagagaaggcatagtgtgacagttgggatatcattgtcaacaccgtcatgctgttgactgtatacttgagtgtgnccagttctcatatcatatagcctgcatgtgctgtcattgg

SEQ ID NO: 4949 - DNA, 565 bp, Musa acuminata
  misc_feature (542)..(542): n = any nucleotide
atttcctaacaatgacagacaagaaacataaactgtgctggtaattaaaggcaactgttgtgaaaattttagtacgaaaatacaaagccaaacaaagatgtatataactgtctcagatcaccagaatgtttcaggtgtaagatattgcaagaagagctcattaacttatatatgcttcttcaagattcaaccatgggttctggtccagatgaatcggtgaggctcgggcgtatacagcttgtatgatgaacagaattaaacagaatgtccttgataacctgagacatgagaccatgcacctgctcaactgtgattttggagctatcacgtgttatcttggccagctgagattcctctggctccttttttctttgtgaaggcaaaagaaaagatcccaaacgtgtgtgagccagttgattttctgcctgctccagcttttcagccaaatctgaaatttgcccagcaacataatctcgattacctaggagaggtgaagaagacaatgtatttacccagtacttattccacagcaaatccaagangtgggatccagagcagacttgaa

SEQ ID NO: 4950 - DNA, 794 bp, Musa acuminata
  misc_feature (10)..(10): n = any nucleotide
  misc_feature (604)..(604): n = any nucleotide
  misc_feature (619)..(619): n = any nucleotide
  misc_feature (675)..(675): n = any nucleotide
  misc_feature (685)..(685): n = any nucleotide
  misc_feature (687)..(687): n = any nucleotide
  misc_feature (772)..(772): n = any nucleotide
  misc_feature (779)..(779): n = any nucleotide
ttcatcgaanatatgttctcatctaaaagaaagaaactattctagaaacaattaaggtagataaatctcattacagattgagcagctatatgtatcgtttatgaagtcgcaagaagaaaacaaataacacttgagttcggagatgacattctcagatttgacttcccacagcacagaaggtttagaaggtcaacctgcagatatgtaaagagccatgggaaaggctgcaaggttccacatgaagggtagtactctcagttcttgcttccgaatccgcgagggctgggtcttgctgatgccgagtctgcaaactgtttcctcggctccgatcgtctcctcctccgtgcagtgccaggaggtgccttttgctctgctttcagtgactcctctaggttgctcaatgctgggatggatcctccttgcatgacccccaataagttcttcattcgaacacgcatttggaatagttgagcaacaagttgactcacctgctgctctgtctttccagactcagtagcaattctcttccttctagctggtgactcagctagaagctctggcttttcccgttcctctggggtcatcacattaatcattgactccntgatcctcagatttntctctgcttcacgaatttgagatggagtaaccttccccatgcctggaatcattccnatgacacggntnacagaacccatttgtgcaacagcacgtgtttgttttaaaaagtcattgaagtcaaattttgcgctcatgatcttcttttgtagtncctcagnatcttcttatcgcat

SEQ ID NO: 4951 - DNA, 774 bp, Musa acuminata
  misc_feature (12)..(12): n = any nucleotide
  misc_feature (132)..(132): n = any nucleotide
tatcggatgtantaagactatccccaacgagggggagagtgtaatgtctgatgacggaactaaatccatacacatgagagaattactcggatccaatgacaagtgcattatatgtataatacatattgctgntttctcctgaaatatgtagaaaggtctttgcaacaaaacattaatttttgcctcagaaaatgttcagcaccacaaacttcctgccagagtgaatctgcaggcactaccgtggatcgatcaccgtgatagtaacctcgttcacagaatgcgttcgcgttgaatcagacttggtagccgatgacttgagtccgtccgtcctcaaccttgcgaacgacgggggttcatttggcagcgggagaggcatctgctcactcttcaacatcagcagcaccgacgacatggtgggtctgtcgtctgggctctcctgcacgcacagcaacccaacctggaaacaccggcgtgcttcgttcgtagggtaacagtctccgagcgacggatccacgaactcggaggctctgtccttctcccacagctcccatgcatgtctgagaagggtttggccgcgttgcagaacgtgcgatgccccgtttctttgcccattcaggatctccagcaggagaacaccatagctgaagacgtcagacttgaaacgagaaggtgccttccattgcgtactccggagccatgtaaccataggttcccacgactctgccagtgttgacttcgtagtcttctcctcgaagatcttcgccatgccgaagt

SEQ ID NO: 4952 - DNA, 714 bp, Musa acuminata
gcagatcataaagtagtatcatttctgttcaacaaaacatattgaagtacaccattcattatgcagcccaatagtttctcctgatcattcgagttatttcaaaacaaatgaggcccagcaaatgatcacatcaaaaatgttctgtttgttgtacatgctgtactgcagcctgaagacacaagtgatacaacttgtttggttacatccgaccatgatgttcatcgaaaactttaacctacaaaacttttaagttgaccacgaacggattcacgagcatttggtagccgacttaattttcatgaagttactttctaatgtagctgagattcccaaacatcaaatgtaatcttccctgaatcactggtggtgcatatatcatatctcaaggtcatccaatgaaatttcttgaggtgagagaatcttcagtttagtggataaactgggaaggatcatcaatactggatgagccgaggatgatttccctcttcaactttgtggtaagcttgtggacaacacgtagctcagatcgagtggctccaccaatgataaatacaaaaatgcgctggcccatctttttaaaatcacttgatgaatgcctcaacacagaatcacttgaatatccatcatcagaacttcgtgggctagcccatgtcgccgcctagatctcatggattgagctggtgcatggtgagtgtggaacagatgatcttgtga

SEQ ID NO: 4953 - DNA, 613 bp, Musa acuminata
  misc_feature (10)..(10): n = any nucleotide
  misc_feature (516)..(516): n = any nucleotide
cctataatanttccttgtataaaatctgtaaagtacatatgacacaagttagaggtggaataatgatccatccactggtggcattcaagaaatggcatgtagaataggtaaaaggatttacatatttgaataacaagggagaggcaatgattcgatggagggtctctcaccacatgcctatagatcacgcagcagcagaaggaaccacatgcttctactgttctttggaagagattgcctcaggaagtttgtttgtgggaggtctatcagctccccttcttgagtactctctccaccttctagccgcagcagcagctctcttagccctctccttcacttcttcctctgtagtttcataattcttgggtgccccccaaatgttgctccaggacccactcttatcagaatccttctgcttcatcattcgtatcttagccctttccaagacttttgcttggcgcttttcccatcttgaacatgccattctgaacacgtcaagggatgagctccccattncagaaagcattagcccaacattcactctctccacccttcgcatttcatcttcaaggaggatagtgtgagcagatgtccggtgatgcaatcaactggg

SEQ ID NO: 4954 - DNA, 597 bp, Musa acuminata
  misc_feature (9)..(10): n = any nucleotide
  misc_feature (14)..(14): n = any nucleotide
  misc_feature (17)..(17): n = any nucleotide
  misc_feature (512)..(512): n = any nucleotide
  misc_feature (548)..(548): n = any nucleotide
  misc_feature (566)..(566): n = any nucleotide
tcatctcanncttncanatttcacattatttgaagaaataattccacaaacaaacacaattcggtatctgttcactgtagactatgtacagtatgattgcactaacgttgtatgtgtcagctcatgctccacgttcctggttctgcctctgcgatttccggaagtgggagttcctgtacaaactcttgccatccttgtgcagggagacctcggaatggatcactgagttggggaatcgttgcttgtgtctctcgtcgtgattgttgtgattcttctcttggatctccaccttctccttctccttctccttctcctcctcttcctcctttggagcgacgtacacgaaggcaccgacggggacgtcgttcaggttgagaagcggctccaacatctccacgacggttctcatctccggcctcgacttggggttgtggctcaagcatttgtaggcaatcgccgcggccttctgggctcctttggtggagtagagtccgtcgaggccggggtccatnactcgccggagcttgtcggcgttggtgaggtaaggncgagcccagtcgaacgangttcttctgcctgttgggtcggttctgtcga

SEQ ID NO: 4955 - DNA, 599 bp, Musa acuminata
  misc_feature (21)..(21): n = any nucleotide
  misc_feature (49)..(49): n = any nucleotide
  misc_feature (94)..(94): n = any nucleotide
  misc_feature (552)..(552): n = any nucleotide
  misc_feature (560)..(560): n = any nucleotide
  misc_feature (587)..(587): n = any nucleotide
ccaataaaggtcatccttganaagagtctgttgaccttatttggccttnataataggtctttaaatatattactccacttttaataaactagcnaagcatcatcgaataaagtaagttccgggcacctcaggttgctgctgctgcttatcaatcaaacgacaccttgtgcacaatccttgctcctcttgattttgccatgtagagtcctatataatgaagcacatcctgaggatgggccaaagctcccttgatgtttcttgcaacatgaattggaaggtcatgtgttgcacaacctcgtgcataaaccacaacatcttccagtggtggaaccaggcctatatttctagcagagagcgtggaacatacaaagtccaacacgcagatatctgtgcatactcctaccaccaaaacgactctgatttcatttcttttcacccaatcagagaacacattagagccatccttctccattgaaccaacgaagccatcaatacaatctttccttctcacagtaaaatttggatccttctccagccatttcagagcagggnctaatctntcttcggccgaaccgatgatacaatgnggtggatacgga

SEQ ID NO: 4956 - DNA, 616 bp, Musa acuminata
  misc_feature (510)..(510): n = any nucleotide
  misc_feature (521)..(521): n = any nucleotide
  misc_feature (524)..(524): n = any nucleotide
tttttattctcattatattcttatagcatgatctctgcattcttatgcagacattatattcttatagcatgactgacagcatcataatctctgatacttatccgtgtgcattctaaacattcttcaagaatgggcagctcgaagcaggcagtcctgcgtcctccatcttcgcacccttgaggaggccaccgagtagctcaccacgatcgtagaagaactccaccttctcgatcttcatgtcctcatcgacttgaaatattgccatcccatagagctccaccatctcccccgtcggtgcatggccttggaaaggcccctccatgaagccccagtgccggaacttgtacacgatccccggcgggccgctgtagacatggacgacctccaaagcgaacccacgaggaaacgccgtggtgaaggcggcgtgagatgactccatcgtctccctcgacgggtcgtacacgcgcaggccttgcggcagcgacgtctgcagcagcgagttgtagccgnctcccaacttncgnttctgttctagcgttatcggtcttcggcccattgaggctgaaggtgtaagttatccggattcacggttttgtagtcttggaatcgtctcttg

SEQ ID NO: 4957 - DNA, 465 bp, Musa acuminata
  misc_feature (8)..(8): n = any nucleotide
  misc_feature (166)..(166): n = any nucleotide
  misc_feature (256)..(256): n = any nucleotide
  misc_feature (268)..(268): n = any nucleotide
  misc_feature (286)..(286): n = any nucleotide
  misc_feature (331)..(331): n = any nucleotide
  misc_feature (341)..(341): n = any nucleotide
  misc_feature (365)..(365): n = any nucleotide
  misc_feature (432)..(432): n = any nucleotide
  misc_feature (442)..(442): n = any nucleotide
gaagaggntcaatttataggtcgatacaagttgattgtctacaaagaatggcgtacataattatatttacaaagtgaaaactgtggctgcacaatatctgtgagggatgcttagcctgcatcaagaatgctaaatagggcttgatgcagatgaaaaaaaaaaagangaaaaaacttgttttcttcctcttaccctcacatcgtaactccaaaaaatcgagttctttgattttggtaatgctaaccactcaaaatgncatgattgccanaaaagggttgtgtcattnctatacagtgaacggtcttgaatccctaaatttgcaacatgccantcaacaagtnttgcttggatacatttacacaganccaggccaactggaaacaaccaccatgccactctcatccgggcccaaattccatggttgtaggtttngatgtttttnacttgaagacttgtaatgtacaa

SEQ ID NO: 4958 - DNA, 724 bp, Musa acuminata
  misc_feature (7)..(7): n = any nucleotide
  misc_feature (14)..(14): n = any nucleotide
  misc_feature (33)..(33): n = any nucleotide
  misc_feature (43)..(43): n = any nucleotide
  misc_feature (639)..(639): n = any nucleotide
gccaaanatatatnatcaaagttaatataagtnaatacaacanccctagctccaaatttagggactaaaggactgagagctcaataatgtggacattttaatgtacataatgaaacaagaattcaagttctctactgacttgtgtcatggtacatataagtttctattgaaggtttttcaatgaggctttggagaaattagaaacaggattggaatttcctttaatttaaacaactgaatggttcggaattgttctcttaatgaaattaatcatgccaatgaatgatgcattagaatctgaagtcgggatcaacatccattgcccaggcgaattttgcaagcagcgacttgttgaatatcttctcgatgggtacttcatggcgcttgcaccatgcaactgatattctaggatcaaggtagttaatctttgatgtccctagtgcaactgtcttgagatcctcttttattcttttatccaactccattttctctatctttgcatcaacctggcacaagcttcttttctatcacatcaggggacaagttcttcttcgtcttcccttctttatctttaagtggaggtttccctttcctagccctattcaaatccatattcaactcgtctctctgggcctttanggcatttatcttctcattcaacttgacatctgactttcatgggacttgagacactgcgctggtgattacatataattgcaacctc

SEQ ID NO: 4959 - DNA, 575 bp, Musa acuminata
  misc_feature (4)..(4): n = any nucleotide
  misc_feature (6)..(6): n = any nucleotide
  misc_feature (8)..(8): n = any nucleotide
  misc_feature (10)..(10): n = any nucleotide
  misc_feature (470)..(470): n = any nucleotide
aaantntnanataacatcattaataactagtttgccaataacatatttctattcgaaacaagaaaatgaaaccattactacaaattaaggttctaattgatttcccataaacaagtcacttggtacttgatactagtcgtaggatctagtctaaaagaaaaactactataatgtcgcataagataattcttgcatcatggccgaggtggatttccagctccggcaggacgaggtccttgcccaggcctcggcagatcatcccggcgtctgaagcgctgtggtggctcacggtttctcctgtcagtgcgagacctcaccctcacaaccttggagtggattgcacaagagacacagtactgcatcttgatatatagctttggcagagtgtacccatcataggcacaggcctcctgcacatccctcacggcagcctgctccactatattcctcacaagaaacctcttgatggncttgtccttggggcagcacttgccgcagttggagcagcggatgaagttaacgtggccgcggccatgcttgttgcgtccaccattcctgcgcttgaaagtcatcgt

SEQ ID NO: 4960 - DNA, 595 bp, Musa acuminata
  misc_feature (479)..(479): n = any nucleotide
  misc_feature (499)..(499): n = any nucleotide
  misc_feature (592)..(592): n = any nucleotide
ctggttgtattgaattcttcattctgatttattcatagcagatggcttttttttttcatcagatactaactaaatattgtccggttcacaaaagttacgattggattcaatgcaagtggccataattttgcttgcatgagcttctctttgtcttctcagctttagatagaatctccagcttcctcaacccatgatgccatcgccaaagtgtggcgtccaccgcaggcaacaagcttggcgcaccactgcccgtcggtgctgccgctgtctcttggtggtagcagtttgatgggcacttccattgggtggccggttgtgaccttcctcccatagcctaggcgtccatggtcgccccttccaaaagagaacattcgcccatcacgtgtacatgccactgaatgagtgcctccacaagatacctgaacaatatcttccccgactaggagttggaccttctgaggaaccattttactactctngtcatctccaaatccaagcntcccatgctcccctcttccccaagcatatacctctccaacattggttagtgcagttgaatgccaacttccagcagcaatgtcaaccaaagtangac

SEQ ID NO: 4961 - DNA, 555 bp, Musa acuminata
aagcttgcagtatttccagaagcaacatctacattagttaagaggcaccacctccctctctactaccacttgtaccactagttcatgtccacctatggtgagaatgatgtattgaacaccagaacagaccattcaactcacaagttggcgtacagcagtcctggaatctgtcggccgaggccacaatgggcagctggttcaccaccatcgagccccatgccgccgtgaagccgtcgggggtctgcaagctgttgcagctgcttccacccatgaagtaggcgagctcactcagggactccagcctggagctcaactccgtcagctgcgtcctcagcagggagttctcagcttccacacccgcgtagtgctgggtggtgatgttgagggcgatgaggatctggctgttctctttctgcagctggctaacctgcgccttcagatcgtccatatgcttctgcttcctcatccgggatcgccgcgccgactcccggttcgacagcatcctcttcagcttcctctggttgatcaaagcctgcacgtctgctcggatccaga

SEQ ID NO: 4962 - DNA, 978 bp, Musa acuminata
  misc_feature (13)..(13): n = any nucleotide
  misc_feature (959)..(959): n = any nucleotide
agaagtcacgtcngactcctttgttcattcttccaagaattcttagcagcttcagcagatgaagtgccagactcaccattaccatccttaggcttagagaagaaaggatcccactcatgtggcccaactgttcgctgaccatcctctaacaaagcatacttccagctgttctcttcaatgacatcatccttttcttcgtggccttcaatcatgtcccttcttagtcttgtaactttgtcgatgattgcctgtacagccacatcaaaggcatcattaagagtctccaacttagacctagggtctgcatatatcaggcttggtataaggcttatgactgactctctcattgtttccataacatgtggagggatttgctttaacctttcctcgatactgacactcctctttcgaatatcatcctcaggtataaacactgagtatgttgagtagtttcttgggagatgccatgtatattgtatataagcagagccaggatgaaagaaaacaggtatgcaaccagccaaaatggagtcaaaagctgatctccttgtatatgaatctccctgtggttgtaagcaaaataaagaactctgaaacatctgcattatgctgcttggggagtgacacttgctctctccaaaatcacactccagcaacttacaaactttggaccttttgcactgatctatgatcttccctctgattgattctggattatcagggcgtggtgcacctgcaaatgagaagagaaacttccgctccaacttcctcatccggtcctgccaaatgaagacatcagcatcctttgctgggtgaaagtatgtaggataaggtatcccaaaatcattagcattccatgggctcgcttccacaaccagcatcgacatgtttcttgcagctggcaagaatagaagcttgtttccccaatctgtttcagaatcagtcaatctcctgaaatnccaagtaattctccctgcc

SEQ ID NO: 4963 - DNA, 566 bp, Musa acuminata
  misc_feature (499)..(499): n = any nucleotide
  misc_feature (507)..(508): n = any nucleotide
  misc_feature (522)..(522): n = any nucleotide
  misc_feature (527)..(527): n = any nucleotide
  misc_feature (531)..(531): n = any nucleotide
  misc_feature (549)..(549): n = any nucleotide
agctatcaagagaacaaaacaaagtcattgaccgaggccagctgataccacacaaagatctaatgactgacgcacaagcagggattagcagcagaaacaaaggaatcacacagccactgcagctacatataggagacagaccatattatcctaatgttttgtttatcctagatttttggcatgttttgtgctttcgaatggagaattcgcaatctaagaggctttcgggggttcgtcgccgggcaaatcatcttcgtcatggtatatgttttccgccatctgccatatttgaaggatgttatcctcggcaacactggcaatgacccaatcctcacaggaattccaggagaaatcagatatcttgctagtgtggccgccgtgaataaacagcagctcgggcgggccatcctctgcatcctccggggtctgttcctcgtcgatcctgctaaggtcccacaccatgagcctcctaccaagacagcaagatgctagaattgtntcattttnnggattccaaccaantttgnaaanctcctctttgtggcagtncaatgtatgtaaagcat

SEQ ID NO: 4964 - DNA, 674 bp, Musa acuminata
  misc_feature (617)..(617): n = any nucleotide
  misc_feature (631)..(631): n = any nucleotide
  misc_feature (639)..(639): n = any nucleotide
  misc_feature (651)..(651): n = any nucleotide
  misc_feature (666)..(666): n = any nucleotide
attaaaatcacaatcagaattcgaatgtaagccatcgcgagtgtcttcatacataaggcgatggggccaaaaccttgagacttgcatatgctaacatcgtaaacagtaagatacccacgtgtacaagtatcataatattcgtcacctaaaaaggttctgagagctaatctacagcagcagagacatggggaaggaaagattcgcgtggcttggtgcaggtgactgaagcagagagcaaaaatgactctggccgggacttcaagcgcccttgttgccttgttggaggctgaccaaggcgtggtacgaccctttgggccccttggccagaagcgacgcgtgggtgcccttctccaccaccacccccttgtccaatacagcgatgaggtcgcagttctggatggtgctcagcctgtgcgccaccaccacgctggtcctccccaccatcagcctctccaacgcctcctacaccatcttctccgactgactgtcgagcgcgctcgtggcctcgtccagcagtagtatcgttgggttcttcagtatgggccctcgcaatcgcgatcctctgcttctgcccgccggagagctgtaccccgcggtcgccgagtatgtgtggtagncgtctttgaagagntatgaagncgtgagcagttnaggccctggcgggtnctctatct

SEQ ID NO: 4965 - DNA, 555 bp, Musa acuminata
  misc_feature (5)..(5): n = any nucleotide
  misc_feature (11)..(11): n = any nucleotide
  misc_feature (23)..(23): n = any nucleotide
  misc_feature (29)..(29): n = any nucleotide
  misc_feature (31)..(34): n = any nucleotide
  misc_feature (36)..(38): n = any nucleotide
  misc_feature (46)..(46): n = any nucleotide
  misc_feature (76)..(76): n = any nucleotide
  misc_feature (520)..(520): n = any nucleotide
  misc_feature (544)..(544): n = any nucleotide
  misc_feature (546)..(546): n = any nucleotide
catanacaacnactatgctactntgtcanannnntnnnaacagatnactaatagtctcctccagtggaaactccanatcagttgtgtgtgcaaaattttgtggaacatcatcagtgcatccaccacacaaacgcacacaccaccaggactgtaataaccatacctgtatacgcaatccacttgtccacgcggtgtcgccgctcaattagcttcaacacggtgttagataaccctacggtattaaggatgtccagggccttcctttgggctctcttcaagcgatccctctgctcggcgtacttagacagaacagccactccagtggcatatgcttcttccagcatcattgaagagtttcgtgcggattgcattgcttgtgcttcctcgtcaaatattctcagaatatgcgcagactccccattagctctttccaataattctgcacgttctttagcttcctgcaccctcttttgttgacggaaggatgcttgtaagactttctttcagtgaatccacctcntctgccactgatccacttttctcntncagagatcg

SEQ ID NO: 4966 - DNA, 689 bp, Musa acuminata
  misc_feature (5)..(5): n = any nucleotide
  misc_feature (14)..(15): n = any nucleotide
  misc_feature (638)..(638): n = any nucleotide
atcanaatccattnnctttctgttgtagcctacagatccaactggaactaccaaatacaaaagttctcagcccaaaaaattagattctggatacaaattccctcagtcttaacaaactgaataatttattggtctccaagcatacattggttgctacacccaaatcttacatggctcattaagaaaaggaatcaagatcgcttggcttgacagtccaatgtcctctcggtagagcaataataagtatgtccaaagctaacgcaatatcaatgatgaaatttaccaggtaaacatgcaacataattaaaataacttaaccaaccagttctcttatctgctagcaaaaactggtgtacatgaaccaaaaccttaacgaatcagtttcctccactctgtccggcctcgatttatttcaagaccggtgccagacgatttcaagaaatgcaagaactgctggagctcctgatcatgtggctttgtggtggcaatcccatttgtgctaccattttccgcaaattctgaactggtaagtgaatccactgcatcgtcatgttggcattctcgcctataatctagagtgattgtctgcagctcatgggtgtcaataatttcttgaggcatgctttcaaggacccatncaatgtaagtcacattgtttacgtgtggtcatgtccaaatcagctcttctt

SEQ ID NO: 4967 - DNA, 592 bp, Musa acuminata
  misc_feature (9)..(9): n = any nucleotide
  misc_feature (520)..(520): n = any nucleotide
tttctcaancaccgatattaaaatttagtagcatttttaacaataatgtggcaaattttatgagctaatacttctacaaaatgatcagatagcggataacaaactcaagtctgaaacaaataaaggctcctagaattggaataccgcaaatgcatattgctcattcctcgtcatcctcgtcaccgtcgccaccggctgccttctttgctgcagccttttgattctttctcttcaccctcccggggcgcccaccaccaaatggacttgtgagagagaagtcgatgtgctttgcagagtccaccctcaccatgaacgacgggatgttaaccacttgcctcccgactctgatgtggcgctgcctgatcaggactctggcatggtggatggacttcgccatccccgacttgaagacaagagtctgcagacggcgctccaggaagttctctactgtgagagccaggacgtaatcgagcttgttctggccttcctcgagtagcccatagcggttcatccggcggangagggctctccctcaaaaatccgacgagggttcttctcgtcgagcgtgagaagatcccttgcagcattacga

SEQ ID NO: 4968 - DNA, 500 bp, Musa acuminata
cactagagaaataaagcagactgtcacagtaatccaaacagatcaaatgggtttaaaatgcccaaactgcaccaaatcatagagcacaaaagggtccacataaaagcgaagtgggcttagtagcagtcattaacttgacataaaatatattaattccttaaaccaggaattccaattgatcatggcttcaacaatcaatttctattgttgcttgacttcaactttcttcttctgccagagccgatccaaagcaccatcagcatcaccctgtgctcggatgaagccagaaagtgcaaaagtggtgaactggccggtgtacacaccactctcatccaaatgcccgatattgatctggactgacgcatggtccttggcagtaatcagcctattcgtagcagaacatttcctcgggatgtagagatccgtcatgtcacctgcttcgttctgcattttgtcagtggattctcttgccggcaaaatctcctgaggcgaaagatgag

SEQ ID NO: 4969 - DNA, 824 bp, Musa acuminata
  misc_feature (23)..(23): n = any nucleotide
  misc_feature (780)..(780): n = any nucleotide
cccacttgtcattttatatttanaagatgaggtcccaccaatgcaaaggattaacattacacaaactgtactttctaaccctgaaattatatattttttttctttaactttgctgatgctattattggaatatggacagcagattcggtgttggattcaacaataactagtggcgatccctgtcctcgttgcattacaccggttgccctccggcaccaccactgcacctttctcaaatgtgacactgcaagatgagacagatagttcatgtgaagacactacttcggttggataaggtatgatgcccagactgcatctgcaggtggtggtggccgcacccagtgtccaggtatccggcttcctccaggtctaatataagcatcccaagttcttctaacttcaattagtgtccccatatcattgctgcttccatgataatagtggaggaactcaaatggtaaattttgacacagagtcatagccactaccccaacccggagcttcatcctcttcttcgcttcctcctccaccattgacctcgggatcatcattctctccttcattatcgttcccctcctctccagagaaatcatctttacctccgtcttcctgactgtccccatcctcatcattgtcatcatctgactcgccatcgtccttgttctcgggaacagcttcaggtttgcttcgtcggagtatccctaaaattacttccgatccttcattccgcggaccagtttgacttgatatagagcccaccgccagaataaagcaaaggangactttcagcagccaatacggtctcggcactaacaattcgacca

SEQ ID NO: 4970 - DNA, 543 bp, Musa acuminata
  misc_feature (267)..(289): n = any nucleotide
attactttatctgcttgtaattttacaaaatggaagaagaaaaatgaagtggagtaagacttgactattggataactaatatagcctttttcatttcatcctaggcttttgcagacttctcactccgttgccgaatctgtgatcccaagctgcagctgaaaggaaggctctcgacgaagaagaggagggctgatgcagagctccaaattaaggtcgggacacttgggggctttttgccgctgtgccgatgactcgtcactgctactnnnnnnnnnnnnnnnnnnnnnnntctcttctttcctctccgatgagattgcgatggttgatggcgcacgctcgtcgaacggccggtgagttatagggtccacacctctgctcaataacttcctcctgatgtgtgtgttccagtagttctttatctcgttatctgttctccccggcagtctcgcggctatcagtgaccatctgttgcccagtagacggtggaggttgacgatggtctcatcctctttcctgggtgaagttgccgcgcttgaggtcggg

SEQ ID NO: 4971 - DNA, 607 bp, Musa acuminata
aggagttctttctattatgtttaagcatccacaaaacaaaggtaattaagatggtcttcatagccacctgaagactgcaagtttaattactgcagcatactcactcttcggattaataatactcagaagaagctctgagctttttggcctcccggtgcaactgactgtagcagcaactggttcatcattcttggcttgcttactgccatcaatggtgagtccaaaatggatgtgagggaagtgtgcccaattctttgccgcggtgatgaatgcttctctgtggctgatgtctggattgttagccttaatcctttgtatttcctcctttatgaacctgttatatgcagacggcacgcgatgtctcttctccggaggacgcataggcagcataatttgttgttgatcctttggcacactgtagaataaggaagtgctgttgaacttggaaggtgatccacatgccatcgtcctgccatcatgagctgctgctgcgttgcaggtctggagatcttgaagagggagtttctgaagcaggtctcccatgttcacagatcagcagattacaacaatgcccgcatcgcactggctacaatgctgaacaagctgt

SEQ ID NO: 4972 - DNA, 454 bp, Musa acuminata
  misc_feature (168)..(200): n = any nucleotide
tatttactacctacatagacaacagcaaggacatcggaagcctagcgatcgttacacaacactaaactaaatcgatcgaaccgaaggagatggaggagatctgtcatccatcttcatgcacacgactcctccttgacgtgaatggcttgtgggagatactgcgccatnnnnnnnnnnnnnnnnnnnnnnnnnnnnnnnnnaatggggctcactcttttgcaggccatgatgagctcgccggagagggagatcaccgggaggttctcgcagttgcagatctcgatcatgaagccgtcgggatcatggaaaaacatctggtccacgtagatcccgccttcctccactcgactctggatgtaaggtatgcccatctccctcagcttcttctccaccaaggccaagctctcgcactggaaggagatatggttgtccttggggttaatttccctcttcg

SEQ ID NO: 4973 - DNA, 568 bp, Musa acuminata
cctttatattttcaataaatatgaaaattacaaactgctatgtctgactccaaacatgaggatcaaaaagaatttcaagatttgtggcctcgtcctaagccgagacagcttcctgtttggcagagagttgattctggatgtgctgtgggacaacatcaaactgtgcaagctgcattgtgtaagatgcgcgtccttttgtcatcccacgaagggtgctaacatattggaacatttcggcgagtggtaccaaagcatcgactaccttaagaccacctggcttatcaccaaagctattgatctggcctcttctcgagtttagatcaccaataacatcgcccaagtgttcttctggggtgactacttccactttcatgataggttcaagcaattttggacctgcttttctcatgccatcacggaaagcacccctggctgccagttgaaatgctagaacactggaatcaacttcatgataggagccatcaactaatgccgctctgacatcaacaactgggtagccagctaacacaaccattgcttatggcattcttccagccctttcatgact

SEQ ID NO: 4974 - DNA, 637 bp, Musa acuminata
  misc_feature (19)..(19): n = any nucleotide
  misc_feature (535)..(535): n = any nucleotide
  misc_feature (618)..(618): n = any nucleotide
aagtaaacatttgttattngcatcccatttaggagggccacagaggaagaagcaacacaagattaacaccatgtcagagaaggcaaagcaaacatcaaaggcttgcaactttcccccatacacataacaaagcttgactcatgtcgaacaccttcgcccggaacgacagcacctcaagacatccatctccggagttcaaatcaaaacgattaatcctctgcaagcatgcaatgacaagcttcagttcctccggagacggattcaatggcacaaaaccttcggacgatgctcaagcgggcgtcggccagtctttccggatctcgaagtagtagctcatgtcgaggtagcacttcccgtcatcatccacgaactttgttcttgcagagtaggatcccctcgcgaagtaaccaccgggggtggtctcttcctccagctcgtacgtgtaaggttccttctgagggctaaatgttcccagcatcaccttcgtgctgtcaactttcatcccggtcttccagaccgtgttggtgtagcggancccggagaacgatgttgttggagaacggtgaaggagaacttgaggcggtaacggctttccgtctttgaacgcgaacgcgaaancctttcgcgtcggggacga

SEQ ID NO: 4975 - DNA, 614 bp, Musa acuminata
  misc_feature (567)..(567): n = any nucleotide
  misc_feature (571)..(571): n = any nucleotide
  misc_feature (597)..(597): n = any nucleotide
tagaaatattatttgctaaagatacttcaaaacattcagaaaacaacatggtccttttacgtgccaacacgtttgtttgcagcaacaaagcaataaaaataagcttcatgtgaaaaatgaaaacagccgatgacagctaatctagatgggacatcattttggcttctcagaacacgcatcaagcaactcaaaccaacagcttacttgatcttcttcttgggcctcagctggttgctgtggccgcacttctttttacggcaattaacagcccttggatgcaatcttgccatagcattttctgcagatcatcttttcctgattatatttcctggctagagccatcagagagggctcaatgataccgcccctcagcctcagcaccaaatgcagcgtcgactctttctgaatgttgtagtcggcgagtgtccgtccatcctcgagctgcttcccggcaaagatcagtcgctgctggtccggcggaatcccttctttgtcctggatcttggtcttgacgttgtcgatggtgtcgctgctctcgacctcgagggtgatggtcttccccgtganggtnttcacgaagatctgcatctttgtcantcgttttgctccctctt

SEQ ID NO: 4976 - DNA, 590 bp, Musa acuminata
taaaacaacttttaacaacaagctcacacaatatacgaagcatattcaagatccaatatgaagctatgaacgtcccacttgcgaaccagctaactaagaggaaatcaccactgcacaactcatactcaatttgcacgacctctgatgacatcgagtcccatttcagtaggatcggtcgcttgcagttccacctgtatcccgtctaactctctcttaaacctgtcttttgagcttgcatagagcatcttgcttctcaccctcgaggtgtcgggagaccatgcaatgaagaagatcttgctcttctggcagttctcctcggtcacgaaatcgaagtcgtagatggcatatctgcactcgttgttgggaaggctagcggcaaaatcgtcgtaacccagagtgggctcaccgaccttctccacgataacctgcttcaacttctcatcgatcttgaacactatgaaacggtacgtccgtttcgccttcagttccaagaacttcagcttgcaatcgtcattgacggccatccctgacgccgcgttggccatgtcggaggagcgattaacgaaagagacgggcgccggagagtagta

SEQ ID NO: 4977 - DNA, 631 bp, Musa acuminata
  misc_feature (5)..(5): n = any nucleotide
atganatattatcccacaccaataattgcatgtagtttccagtaatttacaattagattagctatcatatataaaggtccagagaacacgatcagaaatttatctatttagttcttttcctaagaggatcaatccatcgacgagaaaaggagagctgagctatcatccattgaggtcttaagcacgttcaccacggatgcggcggggcgagttggatgtccttgggcatgatggtaacccgcttggcgtggatggcgcagaggttggtgtcctcgaagagccttaccagatacgcctccgccgcctcctgcagcgccaacacagcgtggctctggaaccgaaggtcggtcttgaaatcctgcgcgatctcgcgcaccagccgctggaaaggcagcttccggatcagcagttccgtgctcttctggtacttgcggatctcacgtagagccaccgtccccggtcggtacctgtggggcttcttaacaccgccggtcgtcggcgccgacttcctcgcgggccttggtggcgagctgcttccggggcgctttgccgccggtggacttgcgagcggtctgcttcgtaacggccatcgatcaccaggaacaacacaagctagggttcgccgatctca

SEQ ID NO: 4978 - DNA, 1134 bp, Musa acuminata
  misc_feature (15)..(15): n = any nucleotide
  misc_feature (19)..(19): n = any nucleotide
  misc_feature (21)..(21): n = any nucleotide
  misc_feature (23)..(23): n = any nucleotide
  misc_feature (95)..(95): n = any nucleotide
agcgtccgtcacacnatcnantntaatatcaggtaaagatggaaaaataaaatacaataaaataattaattagaataaaaataaaaataatttangctaactttgactctgtgggtacgcgataggaggaacaacttcgctctcgtccgagcgggtgccaatagcaatacgagacgcgtaaacccacgatgttgtatatgttaggcatgcggcaacggtggcaggcgtcgtttcatcgagcacctggcaggcattggaacgagaaaagggatcaaatacagcaaactaaacagcagaaacaatcacgagtcttcaccaagatcgctcttgatttgcttcccatggttccaatgccatctctatagtaatatccgcatgctccctgctcttaataatccaataaggcttccatttcaaaacgaggggcggcgcatgatttagagtcgtcgatcggaaaaccctaatccttgattcaagaatcatctacacatgcacaattcaattaaaatagttaccgataaaataaagatggacacatataccattcgatcggcagtcctatatgatctcctctaatttaacaggtcaaatctcttgaacaaagatgctaagattaaccaagcgagaatccacgccagaattaggcgcgttcgccgcgggtgcggcggggcgagctggatgtccttgggcatgatggtgacccgcttagcgtggatggcgcagaggttggtgtcctcgaagagccccaccaggtacgcctccgccgcctcctgcagcaccagcaccgcgtggctctggaaccgcaggtccgtcttgaagtcctgcgcgatctccctcaccagccgctggaacggcagcttcctgatcagcaactccgtgctcttctggtacttcctaatctcacgcagcgccaccgtcccggggccgataacctgtggggcttcttcacgccgcccgtcgtcggcgccgacttcctcgcagccttggtcgcgagctgcttccggggagccttgccaccggtggacttacgagcggtctgcttcgtacgagccatcgagcgcggaacaaggagaagacgagactagggtttgacgatcccaaactacagatcaagcagataataaattaataagg

SEQ ID NO: 4979 - DNA, 542 bp, Musa acuminata
tcggacaacaactacataaagcaaattctacaaagatccatgattagcaatacacgataaattgtgttttctttaatcttcttctgattgattctcactttgccactaatcttattcaatcaaccaatgggtatgccccgctggcacggacttccttgaccctcttttcgtattcatcttcttcctcgacattgttatcttgttcttcttgcttgccttcatcctccccagccggccaaccaaaacctgccacaggtgtgcttgacggtggaggagtccgtgcttcgccccacaatcctcattatctcctcgacactctgcagagaataggtaggggcatcattatcccgcttgtagtattgcgcttgcgctgcttcagttagctctctaggcaggttcttcaagaaccagggatggttccttatttcccttatagtaattctcctttctgggttggcaacgaagatccttgataggatttgcctgcaatcttgggaggtatgaacatattcaggtatcttgtactgtgctgacactattct

SEQ ID NO: 4980 - DNA, 549 bp, Musa acuminata
  misc_feature (496)..(496): n = any nucleotide
caaacagggcatggaggttccctccaacatatagaatgggagttcccaatggaaattgacaaccagaagaacatgaaatgattgagtaaacagagtcccagaacaaagagaaagtgtaagttctgcattatttcactgttcatggtttccagaggatggtggtctcggcaatcatggaggtcacaacatagggatccatgtttgacgctggcctccggtcctcgaaataacctgcacatatggcacacagccatcacaacaaagtttgactatgcagttgcatgccaagttgatgcagtaaaaactatcaagaaatgtacaaaaagaaaaaaaatgtagggaaggaatctgacctttgccattttgctctgtctcacgaccaactcgaatggatgcaccgcgattagcaactccccatatgaaggtgttgatgtcagcagtctcatgtcgtccagtgaggcggcgttcattgccttctccatatgcagcaatgtgntcccttgtgctcttgcaagttttcaatagcactcttgatgattcatatctcca

SEQ ID NO: 4981 - DNA, 631 bp, Musa acuminata
  misc_feature (7)..(7): n = any nucleotide
  misc_feature (609)..(609): n = any nucleotide
aaacaanaagatggatattatttatgcgtaaatattgctgcagatttcaataggtctgaatggcaaacaagagcattccctgtcgaggaagctcttacaaaaatataggctgcatcgatcaagaagaaacaacactaccacctcgcttactgggatcatcctcgcactaagaggatgaaaatggaggctagcaaacatagataacagatctaggaatggatcaccgtagttaaaagttcttggcatggaagtgggagagcagagatgctggtcagacgagcttcccttcacactgatacatgtgctgtttgctggtctccgaaccgtgctctgcctgcggggacttgtcggcctaagttgagccaggactggctggactctggcttgggcctccttggtggccgccgacgagccatggacttgatacggcgccttggtgttgattctgaaacatgttgttaacagagacaagaacgtgaggtttcagctgtggtactacatcatggacactcgagattgaagtacgcaccggtccttcctcttctcgaggaacctatggagggagttcttcctcgctatgggcatatcagaagcggtggccttggcgangctatcggccggtgagatgggg

SEQ ID NO: 4982 - DNA, 623 bp, Musa acuminata
  misc_feature (6)..(7): n = any nucleotide
  misc_feature (12)..(12): n = any nucleotide
  misc_feature (15)..(15): n = any nucleotide
ctaacnntcacngcnctgcaacacacaaatttcacatgaatacaaatatccatatggcagctaaaagagacatacaagcatgtccttcatggtacaaacataaccaagtccatctcaagccaagctgggaaaaagagaatcagctcaagcttcctccccttcctcttcctcttcctcataatcttccacatcagctgttgcatcctgatactgctgatactctgccaccaagtcattcatattgctctcggcctcagtgaactccatctcgtccatgccctcgccagtgtaccagtgcaagaaagccttcctcctgaacatggcggtgaactgctcgctcacccgcctgaacatctcctggatggaggttgagttcccaatgaaagtggatgccatcttcagccccttgggtggaatgtcacacacactggatttgacattgtttggtatccactcgacgaagtaggagctgttcttgttctgaacattgatcatctgctcatcgacctccttggtgctcatctttccacggaacatggctgaggcggtcaggtaacggccgtgacgggggtcggcggcacacatcatgttcttggcatcccacatctgttgggtcaactcag

SEQ ID NO: 4983 - DNA, 598 bp, Musa acuminata
  misc_feature (4)..(5): n = any nucleotide
  misc_feature (8)..(8): n = any nucleotide
  misc_feature (13)..(13): n = any nucleotide
cccnncgngatancattctcagtgacagtttttattaaggttaaattgatcagctcacaaagctatcgttacaacaaatcgagcaaaatgatacaacagttcggtcccataggcgaataggaattgaatgccacaaagcaagcaggtgtcggtagagctctaactaacatgagcaatgtctgtgtcctccggaatcttgaatgtctctgctgcaccaaatttcctcctccctccttcccactcatcctcggattccggactgctgtccccgtcatcatgatggctcgccgatgatggtgtcaaggggtcatcgatgctcttggagatgcagttgtgggttgcaagcattttgacctgacggagatgagagatctctacgacaaccgtgtcgtcatccaccggtagaggctgcttccatggctccccatcgattcgcatgaatgtgtgatccgctgcacccttgtggaactcgaaccgaattcttcgtgcctgtgcaagacgggttccatgcccatttggggtgaacaaaacaagcccatgccatgcgtcccggaaaccgacaacctcaagaaggccgtcatcaacataaggtggagta

SEQ ID NO: 4984 - DNA, 602 bp, Musa acuminata
  misc_feature (10)..(10): n = any nucleotide
cattgagttngactttatcaccgcgataaatcagaagaaacactgaccaccatcacgatcatgatcgaccagagattacacacgaaggagcacaccaccatctcgtgatcttggatgtatggagatggagtcagagatggatcgaggacttgaatcaaggaacaggagcagagagaaataaggataaacaacaaggtgcatgatcgaaggaagcaaagtgcacggacttttcgaaacaagtacgtaggagcgccgacgacttcgacagccgcctcagtagtcggtggtcgggagctgctcgtgggagtggctgatgaagaagaactcgtagacgatcccggcgaggccgccgccgatgagcggaccgagccagtagatccactggtgggtccaggaccagctgacgagggccgggccgaaggacacggcggggttcatggaggcgccgctgaagggcccgcccacgaggatgttggcgcccaacgatgaagccgatggcgatgggggcgatggtgccgaggctgcccttcttggggtccacggcggtggcgtagacggtgtacacgaggccgaaggtcatgacgatctccagcaccagcgcc

SEQ ID NO: 4985 - DNA, 564 bp, Musa acuminata
  misc_feature (5)..(5): n = any nucleotide
  misc_feature (7)..(8): n = any nucleotide
  misc_feature (16)..(19): n = any nucleotide
  misc_feature (21)..(21): n = any nucleotide
  misc_feature (24)..(24): n = any nucleotide
  misc_feature (34)..(35): n = any nucleotide
  misc_feature (38)..(38): n = any nucleotide
  misc_feature (73)..(73): n = any nucleotide
  misc_feature (82)..(82): n = any nucleotide
  misc_feature (95)..(95): n = any nucleotide
  misc_feature (134)..(134): n = any nucleotide
  misc_feature (153)..(153): n = any nucleotide
  misc_feature (178)..(178): n = any nucleotide
  misc_feature (188)..(188): n = any nucleotide
  misc_feature (392)..(392): n = any nucleotide
  misc_feature (431)..(431): n = any nucleotide
  misc_feature (552)..(552): n = any nucleotide
atttntnnatgcattnnnntnggnacatgtactnncanacgtagaccaagtatcgatgtatcagatataatgncaccacagnagtatcataagantgtgtacaagagaataggaaccagaaatacacatagaanataacaattttgttttttntttccccaccatttaatagcttgcngatgaacagngcagtaggatctatcaaacccagactttctgccagcatttaatgtataccaaatcatttttacatgatccagactcacttccttttaccatcattaacctcactagttactacattgccatctcagcttgcaatgcagcaagttcgtcttcttcagcagtatttttctggggagcaagtcgggctggtactctaccagcaggancataaactggagaagaaggaagcagttgaagcaggctgnagaagctgttcctccaattctgctccctccagctcttccagttctgcttccaattcatcttcatcaaaatcagctgcagctccaataggagtggctaatgcttcctgaatttgtttctgtnctctgtctgttc

SEQ ID NO: 4986 - DNA, 353 bp, Musa acuminata
  misc_feature (38)..(38): n = any nucleotide
  misc_feature (45)..(45): n = any nucleotide
  misc_feature (49)..(49): n = any nucleotide
  misc_feature (56)..(57): n = any nucleotide
  misc_feature (93)..(93): n = any nucleotide
  misc_feature (139)..(139): n = any nucleotide
  misc_feature (142)..(142): n = any nucleotide
  misc_feature (148)..(148): n = any nucleotide
  misc_feature (181)..(181): n = any nucleotide
  misc_feature (193)..(193): n = any nucleotide
  misc_feature (207)..(207): n = any nucleotide
  misc_feature (218)..(218): n = any nucleotide
  misc_feature (227)..(227): n = any nucleotide
  misc_feature (235)..(235): n = any nucleotide
  misc_feature (246)..(246): n = any nucleotide
  misc_feature (279)..(279): n = any nucleotide
  misc_feature (287)..(287): n = any nucleotide
  misc_feature (292)..(292): n = any nucleotide
  misc_feature (295)..(295): n = any nucleotide
  misc_feature (299)..(299): n = any nucleotide
  misc_feature (316)..(316): n = any nucleotide
  misc_feature (344)..(344): n = any nucleotide
aaaatagactttttggttttcatgtcacgtcctgaacngagatgntatntgttagnntttatgagggtaggatggacattctaagggctgttntaattggaccacctggaactccatatcatgatggccttttcttctncgncacttnctttcctccgaactatccccaaacccctccganggttcattatcnttctggtgggctcngactaaacccnaaacttganatgcttangggaaggtttngccttaagccttctgaatcacatggcctgggcngtggatgngaaancanggantccttaaattcaacaangctgcaggtcttgatctctattcaggcncttgttctc

SEQ ID NO: 4987 - DNA, 333 bp, Musa acuminata
  misc_feature (12)..(12): n = any nucleotide
  misc_feature (119)..(119): n = any nucleotide
  misc_feature (186)..(186): n = any nucleotide
  misc_feature (197)..(197): n = any nucleotide
  misc_feature (288)..(288): n = any nucleotide
  misc_feature (309)..(309): n = any nucleotide
tcctatttcctnatcacgaaatttaatccgtcgactccacattgcttgtaagtgagcgattgcctcctggggctgatcacgatcgcacaatccaccgatacctacttgatttaaataantagtaaccttaatttctgtaacatattatttaatttttatctaaagaaattggaatgttgggtaggnatcgggcaganagagcggagggtgaagggcgtcacctgaaccctagggggtggagacgccgaggacgaggatcttcgcggagacgtcgccggtgaggcggangtcgacgcggtcgttgagganggcgtcccgaacgaggtcgagggc

SEQ ID NO: 4988 - DNA, 324 bp, Musa acuminata
  misc_feature (7)..(7): n = any nucleotide
  misc_feature (133)..(133): n = any nucleotide
  misc_feature (316)..(316): n = any nucleotide
aatttgntcatctagattggaacaaaagatagaaaaaggctggcatttaaagtgaaattacaaaagggaaaaagaagtcctagcacaaaaaaggagtaaactttgcaccatctcaagtcatctaaaacctgtngcaatgtggatgatgtacttatcagctcctgcatgaaagtgtgttccgccaccagggaaattgatctttgtcacccattggacgaccatccaccttctgtcagacttctcctccggcaaagatgtgtatgggggatgtttgccttccacacctgatcccggctttgcaggccagcttattggnaccttgta

SEQ ID NO: 4989 - DNA, 300 bp, Musa acuminata
  misc_feature (10)..(10): n = any nucleotide
  misc_feature (13)..(13): n = any nucleotide
  misc_feature (15)..(15): n = any nucleotide
tattttaatnatnantgatcagtaataatacaaaccaataatggcgcacgcaaaagaactttcctgaactccaccccacgcacacaccaagccactaataaacttaccattcgcgggtccctctcaggaatcagatttccaatggtcgggcctgagtgtcatatccttgaggcagctgagagatgaagttgtgggcattggctgccttggctgcagccaccaccacatccatggtggcgtcttccttcccgaagagtatgttctccttgatggaggtggcgaacaaagctggctcctggc

SEQ ID NO: 4990 - DNA, 255 bp, Musa acuminata
gtgctgtgtctttgctcatttcagattttcaggacaacattgatgcaaaggttattgtagctggtttgtcaacaacatgcagtcagaagattcataatcagttagttggtgtggaaagaatgcataaagagagcaagtacgtgttgttcctggatgatgatgttaggctccatcctggatcaataggagcccttacatcagaaatggagaaaaatcctgagattttcattcaaacgggttatcctcttgatttgc

SEQ ID NO: 4991 - DNA, 631 bp, Musa acuminata
  misc_feature (2)..(2): n = any nucleotide
  misc_feature (8)..(8): n = any nucleotide
  misc_feature (594)..(594): n = any nucleotide
cnaagtcncatgtatctataaaaataacttgcctccttcacattgacaacatgctttcctctgcaaacaaataaacgagtcacatgctctcgctcatttatctcagtatgtttaaacccagatgaaataccaccatcctgtggtattatacatggtttgaaataagaaaggaacttctcagtctcatgaccttggacttcacgatattgaacagcacgaccaccgagggctgcgtcaagttcaaccgtcttgattgcagcagtcccagcttcatcctggctagtatctttaccaagccaatagtgaatatcatgttgaagagaaccactttttaaggcagttgtcttaagaatcacatatgaatctccagtgaaaaacttcccataagatgaactcggtacagggactgggtgaaaattttcaatacgccatatctccagtccagccttttgcccagctccttgaaaagctgaatccacatccttcatggacactgccatactggaaggactagctttggatgttgtcttaaagctagaagaagcaaaattctgcggtggctaagatcgtgcggcgacaccgacgcaggtagangggcgcacgtcgggaggctagtcgtcgaccgatcgat

SEQ ID NO: 4992 - DNA, 156 bp, Musa acuminata
  misc_feature (39)..(39): n = any nucleotide
ctaggcatactttcatcattcttcttcaaatatgccganacaatcttgaagaagtattcatctactgttgccacaacttttactggcatcgcatctgctgcattatttggtcatacattgaccatgaacttcatcttggggttatccatagttttt

SEQ ID NO: 4993 - DNA, 622 bp, Musa acuminata
  misc_feature (4)..(4): n = any nucleotide
  misc_feature (9)..(9): n = any nucleotide
  misc_feature (358)..(358): n = any nucleotide
attntgctncaatgtgaatagacaactaactagtttatatccatatttacaatgtcataaatctggagaaatggcctcccttcttgcaggaggagatcttctttcacgtcactaattacacagtattaagaatttttagcttgtttgatgcccacaaaaaagcctactcttttatgttcttccaatggcacatcattcaggtagagtcatcaaaacaactttgatataacgcgacaagaggaccagaaggctacagatgctgccctgattattgctggattctggtatatcccaatagcagttgcaccccaagaagcaacattgtaaatgactttgcttccatcccatgccttctgangcttgctcttcttcttctttccagaaaatgttttgcatagggcatcttgaagctgatttggagttaattctttagtttgctttagtgctagtaggtaggcagccatgaaggatgtatgccatccacaatgtcctcttgctgacaagaacataatcatcttggtctgagtcgttcccttcatcaacaggcctatcttcccgcaagtctgcggcggtaatcacatcccaagtgatcatcatcatgacattattgcaacagatgctg

SEQ ID NO: 4994 - DNA, 621 bp, Musa acuminata
  misc_feature (3)..(3): n = any nucleotide
  misc_feature (12)..(13): n = any nucleotide
  misc_feature (303)..(303): n = any nucleotide
  misc_feature (305)..(305): n = any nucleotide
  misc_feature (510)..(510): n = any nucleotide
ttngaattatanntagataaaactgtgttccgactatatctgttacaagtaattgaatcactaaaaagtgaagtgcccttctctacaaaacaaaaaaaaggggaaaaaagacggctgagattcattttacaatagcttatatggcagatgacccgagcatcttccaagatcaaatgaagatgtgacgagtaatcgaacctacccaaagcttaattagtctgaagttgttttgaaccaccacccgttggatgctttacaggacaccacaatttgagaatatcagattcaccgcacatcgcttgntnaaccctcgaccggttgtagccgtcttttcctgcttcacagctcaattccagctccaactaatgcagctgtgactgtggccgatgcttcttcaagtgtccgtcgctttttcactgtattgaaggcctcaataacatctccagcttcccaatcatcaaaatcattaacactaataccacactcgagcccagcaccaacctcctttanatcttccttcacccgtcgaagagaatcattgtgccagtatgaactgtctttccgtttcgaacaacccgaacaccacagtctttcaccacctttccttcagtgacatgcatc

SEQ ID NO: 4995 - DNA, 621 bp, Musa acuminata
  misc_feature (19)..(19): n = any nucleotide
  misc_feature (161)..(161): n = any nucleotide
  misc_feature (181)..(182): n = any nucleotide
  misc_feature (185)..(185): n = any nucleotide
  misc_feature (192)..(192): n = any nucleotide
  misc_feature (221)..(221): n = any nucleotide
  misc_feature (592)..(592): n = any nucleotide
tctttagtataagttgtgntccaaaggtctgtcaccacagaataaaacctgcatcctgtccctttcacaacatcagacacaaatcatgcttctttagacactctgttttagccatggcacaggtctccttggcctggaccgtgtactatattatatttttnactaataaccaaatactggnngtnaattganccaaatactttttacctaaaacgattatnatgtgattacttgcactgtctcaggcggaaattctcctccgacaagagagacagcataagtcgctccagcctgattgcaccaggacctggtcgaaggatggtggtattcccaatgaccaggcagggatcactgccgttttctctactccctacgcaccaccctcctagaacaatcatgtttggccgacggaacaatagctcagcgtcgatcttgtcgagtataggatggtccctgcggaacttccgtgcaaatggtgcattgctatctactatgtgcgacatgtcattaatgctgaggtagtgcgggtgctgcttcggaggattatcccatgagatgaagtggaggtcatgattgacagtggtattgcggnattccttgcgtgcatatgacagtgtggaa

SEQ ID NO: 4996 - DNA, 620 bp, Musa acuminata
  misc_feature (14)..(14): n = any nucleotide
  misc_feature (18)..(18): n = any nucleotide
  misc_feature (175)..(175): n = any nucleotide
  misc_feature (218)..(218): n = any nucleotide
tttgcatacatgtntganagtaccacaagattggatcaccagattggggtgtgcttaacgaagcgcaggtcgaccgaggacggaggttaacgctaaacagggactgtcctgccgtaaggagcaggggaggaggtgtcctgctcctcttcgttctcgccggacatttcctccagcnatttgcccttcgactcgggcaccaggaaggtaaagataaggcncacaagattggatgccgcgagcacgaagagcgcgttgcggacgccgatgccggcagggtaccccttgtcccgcttcgtcggatcccggctctgcgccgcgtacaggaatccgaaggcgcccacgatggccccggccttgcccgcggctgccgagatgccgtggcatgtggaccgcagccgcgccgggaagatctccgccggcacgatgaaggtggtgctgttgggcccgaagttggcgaagaagaaggtgaacccgtacatgacgacgaagccgatgtggttgcccgaggtggtccagtgatggtaggggatggcgaggccgagcatgaacacggtcatgaagaagaagccatgagtggatggcgaaccggccatggtgtcatgaaggcgacgtgaaccagt

SEQ ID NO: 4997 - DNA, 618 bp, Musa acuminata
  misc_feature (142)..(143): n = any nucleotide
  misc_feature (177)..(177): n = any nucleotide
  misc_feature (230)..(230): n = any nucleotide
  misc_feature (249)..(249): n = any nucleotide
  misc_feature (358)..(358): n = any nucleotide
  misc_feature (380)..(380): n = any nucleotide
  misc_feature (402)..(402): n = any nucleotide
  misc_feature (404)..(405): n = any nucleotide
  misc_feature (457)..(457): n = any nucleotide
  misc_feature (542)..(542): n = any nucleotide
  misc_feature (605)..(605): n = any nucleotide
attcaacttaaaatataccaaatggaaaaacacactatttgagaacaagagaaggaatatggtgagctgtctctctcaatgaaggattatgtacactcgcatttggtaatgtaggactgaactcgagaacatccatgagaannagcaaagaaaaggtaaaataccaaaatagaaagnattcaaagccaccctgactcaaaatatcacatctttatacaaccacctcttgnaatcctaactatagaaggnaaaagaaggaaaagaaaccaataatctcaaactccccgacagtttcgcgacgagttcagcccaaaatccagctcaggctgatgaagagttggaaataacaataccaagncacatttgagtgcccaaagggntcagatccaactctcggaatangnngaaaacggtgatcgaccaaaaaaagactttttgtcccagcaaaacctcacgnttccaccaacttgcggtgttccatcgttctttaccttctgttctggaccagaccttgatctgcttgggctcgatgttggagaggntgggacactctcgtataagctgctgccgcttcagggagctcggcttggggcactcgctgtagnccctctcgagcgc

SEQ ID NO: 4998 - DNA, 617 bp, Musa acuminata
  misc_feature (15)..(15): n = any nucleotide
  misc_feature (521)..(521): n = any nucleotide
taatgttgtacatgngaggcactaagcgggaatgcatccctcaacattctacaatgcctaacataattccagagcatgtcgggcaccaatgtttcactgcagcagtaatacttcctgcacagtgcatcctaaaggcaaccatgtggtgaatacatataacaaaatctgcagtcagtagtctacactgtatctgcccctgcctaaaatttgctgacattcaaaaaggtcacaatgccacaaagctatgacgacgacgatgccacagcctctcgaacaccatctcccatcatatgcatcaaaggtatcagcacaacaaacttgagagcaggtagatgcttatgtactcaatattgttgctcaaaattagccaaaatagcctcgacaatttggagatccacacaggcacttcttagctctctgcgatataaagccagttccaattttctgttgaccagcttcatctccatgcagaccataatcatatgtcagttcagtcatgggaggaatgtgtttgattgcanagaacattatatgtggatactcttcatcaccatgatcatatagaactggttgccaaagacattaggcgagagctatgatcataaaacgtgtatgtt

SEQ ID NO: 4999 - DNA, 616 bp, Musa acuminata
gtatttgattcggtcgagaggagaagcgaaatcggaaaagagaacgagaagatggggtatttgtacaccgatttcgtggatttgatgaagaagccggcggtggcggaaaccctgatcgacatcctcctctgcgcggtgcctatctgggtggcagtgatgatcgggttggtcatcggctggtcgtggcgcccgcgctggacggggctgctcttcttgggccttaggagcaagctccggttcctgtggacggcacccccgggcctgggcgctcgctgcctctggtttgccttcacagccctctcggtcttctccgtgtgccacaagctgtgctcgtcctcgatctttaaggggaaggctgggaggtcccaagacgtcgaggaggattcttcggtggcgaagacggcggcttcgcagattttgccggtggttgaaggggatggcggcaggtctagttcgaacattggactatctatgagtgaacacgaaattgtgactgagaaagatctaaagcatctattgcatcttctagatggtaaagttggagatacagtctggcaaaatctaatggaacgcaccacatcaaacatgatctatcaagcatggatcatgaacctga

SEQ ID NO: 5000 - DNA, 615 bp, Musa acuminata
  misc_feature (3)..(3): n = any nucleotide
  misc_feature (13)..(13): n = any nucleotide
  misc_feature (576)..(576): n = any nucleotide
tcntttcttcatnaagatcctccaccttgccttcctcagtgtctttcttgtcttcctcatcctcatcatcagaaatttccttctcagtggtcttctcagtccaaagggaaatagggtagctgatgaactcagaatgcttcttgatgagatccttgaggcggcgctcctcaagatactccaactgatcctccttgaggaaaagtgtaatctttgtccccctaccaagactctcaccagaaacatccctggttacggtgaatgaacccccggcctgtgactcccacacgtactgttcatcgtcgttgtgcttggtggtgacaacaaccctctccgccacgaggtaggccgaatagaaccccacaccaaactgaccgatcatactgacatcggccccagcagcaagggcttccatgaactctttggtgcccgacctggcgatggtaccaagattgttgacaaggtcagatttagtcatgccgatgccactgtcgatgatagataaggtattggtagccttgtcggggataatatggatgaacagctccggttgcgcgtcgagttagtcttgtcggtgangctctcgaaccggatcttgtccaacgatcggaggagttg

SEQ ID NO: 5001 - DNA, 613 bp, Musa acuminata
  misc_feature (4)..(5): n = any nucleotide
  misc_feature (9)..(10): n = any nucleotide
cccnngacnncgacaattattttgtagttttgacttggagccaactacaggctaatcgacattcctgtcagcaattgcttgaacagtaatattttaaagatctacgttctgacacaattcaattctgcgtctctgaaccgccatctttcacgggcctatgcgagtaacatgggtggctaccagaatgaaggctttgttgaagttcttgctgcgcaacagagtccagagaacccaaactggtttcagggtactgctgatgctgtaaggcaatacctgtggctctttgaagagcacaatgtcatggagtatctaattcttgccggagaccatttgtatcgcatggactacgagaagttcattcaagcgcacagagaaacaaacgctgatattactgtggctgcgcttccaatggatgaaaaacgtgcaactgcttttggtctgatgaaaattgatgaagaaggacggataattgaatttgcagaaaagccaaaaggagatcagctgaaggcgatgaaggttgataccacaattttaggcctggacaatgaaagagcaaagagatgcctttcattgctagtatgggtatctatgtgatcagccaggatataatgtt

SEQ ID NO: 5002 - DNA, 612 bp, Musa acuminata
attcactgtcatgataaaacagaacaaaggactccaaagttacaaagacacaaaatggctggaacaagacaaccacaagcttgtttctcttacagaagcttcagctttatccctccacgctcttctatggagagattatatggtcaaagtgacacagggaactaaaaccactcattaagagagccctaccagttaaaaaggatgattatatgatgccaaagtatacaaagaagtgaggagtttgagtttctatggacaattagagtttctaccaggaccgccatagtagaagaagtgcccccagtgattactattgcctgtctgcacatcatagcagttggattgctcagtgaaggtgccaactcctctaggtgccttcaaattgttggattcatcaactatctgtatgtttctgaagtagcttgatctgccgaatccttcttcagggaaatggccactgcccatcgcggtcgaggtgtgctcaccatctggttctgagttcacaacttcccctccccattccaccatggaagcactgtccgccaagtaagagaaaaggaaagaaggccagtaacctagcacatagtcgttcccaaactgcatccaccaatg

SEQ ID NO: 5003 - DNA, 610 bp, Musa acuminata
acaaaaattactgatacatctcaagtttggtgggatgaactcaaaagatgaaaatacagtgatgatgtgtgaaatattctgaaaggttgaggtttagaaactgcattgccattgatttgggcatgaaaaatcatgaaagtaaagcaaatatcgaaggttctcttacatttttcattaagaatgacgatcaaggaacttctcaattaggaccgagaatgctgcaaaacctgcacaaccaacgcatgcagccttcggaccaccttttgcagaaatagcccctcctgtaacacaaccagcaacaaatgtatttgtggtgtcatgttttgctcgagccttctctataacacactcagcagctgagaaaataaagcccatgacagcaaatgcctttgcagagctataacttctccgccccatttgttttgctgtatatatgaattgctgctttgccgtcatctcatcctgcattataggttatccagagccccaagaaacaagcccatgaatagaccaagtccaccacccatgatgccactgacgacgctgcggacggcgcagttgttccagatgtcctggctcgtatctctccgggtcggagcgagggtctatc

SEQ ID NO: 5004 - DNA, 604 bp, Musa acuminata
  misc_feature (7)..(7): n = any nucleotide
tgtttgntctgcataaaaggggcaatgttgggattatttggcctagcctccatgtcctacatgggtcttacttgcttattccagttatcacatacaccacatttttctctagaaagcacggcatacatttttcgccgaatagttcaaacataacgaacactacatcacaaactcagtaacatatggttgaaacacacaacttagtatttctcccaaaacgagagagaagttattacactcagctgcccaaccatatgtgaacacatcatgcatcgccggatccaacaattctcattttgagatcataagttttggcaaacaattcctctctgttttccttgaaaagaagataccgtgagctgaaccaaaccgtgtatccgaggcccaccatctccagtattcttgggagcaaggggatggagtcaattgctgaaacaacagcggacaaaacccatccggcaaagaaagcaccggtgccatatatgacatatgtggccatctccttgaagcccaacttgtcggcagccacctcgtcaccgacgatgtccaccgccaccaggttgtgcccgaacggcgtggcgcggccatccttattgcatccgta

SEQ ID NO: 5005 - DNA, 602 bp, Musa acuminata
  misc_feature (11)..(11): n = any nucleotide
  misc_feature (16)..(16): n = any nucleotide
  misc_feature (19)..(19): n = any nucleotide
  misc_feature (147)..(147): n = any nucleotide
  misc_feature (302)..(302): n = any nucleotide
  misc_feature (389)..(389): n = any nucleotide
  misc_feature (402)..(402): n = any nucleotide
  misc_feature (416)..(416): n = any nucleotide
  misc_feature (466)..(466): n = any nucleotide
  misc_feature (491)..(491): n = any nucleotide
  misc_feature (509)..(509): n = any nucleotide
  misc_feature (551)..(551): n = any nucleotide
atgtggccatnagctngcncaggattttcaatcatgaggagaacagcttctattgcatccttgatgtagacaaaagttctttgggactgaccaccatcgacaagtttcagaggctcacgtcgcaggagattattactgaagcatgcnaaaaccctgggaacaccctcgctaggaccatcgattccagggataaagtccatccttggtccaatccaattaaaaggtctcacaatggtgaattcaagaccattctccgcaccctcagcataaatcagcctctcaataagttgctttgcacatgnataagaccatctctgcttctcgatagaaccaaaaatgcatggggaggcatcttccttaagtacatagaagtcgggttcctttcttanagggtgatccttnggaaggaagctgcnaattgttttcccatacacttcacaagtggagaagtgaatcaggcgcttgntgttttctgagcagtatctaacaantgggagagcatcgatganattactgtagatggtgtctagtggacgggtgtataatccgcnggtgtacatattgctgccaggttgatcgtcagattcggacatcttgatgag

SEQ ID NO: 5006 - DNA, 601 bp, Musa acuminata
  misc_feature (7)..(8): n = any nucleotide
  misc_feature (11)..(12): n = any nucleotide
  misc_feature (14)..(14): n = any nucleotide
  misc_feature (23)..(23): n = any nucleotide
  misc_feature (28)..(28): n = any nucleotide
  misc_feature (32)..(32): n = any nucleotide
  misc_feature (507)..(507): n = any nucleotide
ccccccnnccnncncccgacttnacaanagtnagggacacaatctcataataatttgtttgaaatatcttctcctctcttctctcttgcaaacgaaaagacttactaatctgctatcaaaacgctcaaattctatgtgcacctcattgactaaggatagatcgagaataagccactataatggacgaatggcctacatgtcacacaccatacaactcttgcgacaattcccagcagtctcattgtttccgatcatgtagaggggattcttttcgcactctcctgcagcagcccatcgaggacaaaactcgcttgcatccgagcaatcccctcttgtgcttgtcctctgtggatcctcaaaggacctgacatggatccattttggtgctgaccacttctcaccttctatgacagggcagcttccatgtaaactggctggatctgttgtgccatcgatgtgaagactgaagaagagtacagcatcacccttgtgaggtttcactgcaangccatttcttgcacactcagaccaggtttcatctttatgctgagatgaagcaccctctgcattggaaaaacagtctcccaccctttttcacagt

SEQ ID NO: 5007 - DNA, 601 bp, Musa acuminata
  misc_feature (3)..(4): n = any nucleotide
  misc_feature (18)..(18): n = any nucleotide
  misc_feature (442)..(442): n = any nucleotide
canntgttttcgttaacnggttatttcatctaacaaatacattttgtcactgaaactgtactcctcaatcaccaagaatgatactttcaagaatttcatcacactgtgctaaccaactaatctgaacatgaataaaattggcatttaaacattatccaccataatcagaatgcccaagaaaatgctcataccgtgtcccattgagcatcttggaaacatcttcccagtttgtaacttgctctggtaggggcctggtgtgaatcttcacttgccgactcactaatttcctctcaggaacactgagaaattcttgtacatgagataaagcattttgattgccgatgatctcttcgtaatacaatacaatgtggcgcatgctgctaaagaaatgcaggcaatcggctatcgtcctctcaacatagctgaaattggccatcagaantgccacattgattgtgggcttgaatcgtgccagaacctcagcctcttctgttgaatgaacatgtgatttgtgaataccatttagctgctttgcatatctatcgtaatcattagcgagcaagaataagcctcgtaagatgttctccgaaaagaaaatgat

SEQ ID NO: 5008 - DNA, 600 bp, Musa acuminata
  misc_feature (2)..(2): n = any nucleotide
antccgtctaaagcatattaaaatccgtagcaacagaatgagtctatctagaaatagaatcaccataatcttcagcagcagcaacacacaacactggtgccagaacagattaacaactaaagcatacccttagggaatttagtcacaactagtccatcttgtcatgccaacaatatgatcagcttagcttgtatttggaaattttgcctcgtattgctggagggacatgaaagtagctgtgatcatctttccagcaaaccacctcccatggagtgcattctgtgctttcatggctgaggttatattgtcaaagcgtaggtatacatagccagcactatttttgtccacagaaatgtgttttactgtgccaaacttggagcattcatcttgaacatcgtccttgatatctaaatcaaaatctggttccgcctccacactaggatcaaacatatttttcaacagtaaacattcactaggaactccagcagtctgtaaagcaggtgcagttgctgaagcaactggaagacctgaagctggaaggcctgcgagtgaaggccagaaggttgcaggatggaggaaactagaggaggaccaagaact

SEQ ID NO: 5009 - DNA, 597 bp, Musa acuminata
  misc_feature (12)..(13): n = any nucleotide
  misc_feature (350)..(350): n = any nucleotide
  misc_feature (401)..(401): n = any nucleotide
  misc_feature (440)..(440): n = any nucleotide
  misc_feature (479)..(479): n = any nucleotide
  misc_feature (522)..(522): n = any nucleotide
  misc_feature (536)..(536): n = any nucleotide
  misc_feature (539)..(539): n = any nucleotide
  misc_feature (552)..(552): n = any nucleotide
  misc_feature (554)..(554): n = any nucleotide
gttgctttatgnngccccccaaagacaattgccatccaagtgtgacaaaccatcgagcagcttgcaagcacaagaggcatgccttatttggcagaaggaaaatggcagaagcagcgtcccaagacataacaacatattacagagaaagcagatgatctacttatcatcggagaggtggcagagctccacctgctcccacgactccaagctcttgtcctcggtgtcggtcttgtagagggcgagcgccgagacctcgaagctgaggctgaggatctccttgtccaacgcctcaaccctctgccgagccctctccttctcctcctccgtcagtccccgtacaagaggctcanatggggcatatatggagtcgcgttctcgtatccgaagtggccgcaagacanggcgctggtttccaccacctcgggactgggatcgatgangaggaagacgcactggtataagaatgcgccacgggaganctgcggagacgcgggcggggtacgggtagagcgcggtaaggcngaacggaagcggcnganggcatcgtcgggncnagggaattgcccgacaacggtgatgtgggggtccaatttgggg

SEQ ID NO: 5010 - DNA, 595 bp, Musa acuminata
  misc_feature (17)..(18): n = any nucleotide
  misc_feature (231)..(231): n = any nucleotide
  misc_feature (233)..(233): n = any nucleotide
  misc_feature (240)..(240): n = any nucleotide
  misc_feature (513)..(513): n = any nucleotide
  misc_feature (546)..(546): n = any nucleotide
  misc_feature (576)..(576): n = any nucleotide
  misc_feature (590)..(590): n = any nucleotide
ggaaccaataaattgcnntctgcttatttattttacatccatagttcgaatggagaaagaaaaagtgaaatcagctaaaatatttctctaacaaggctttagaaatggctatagagttgcctgcagcttcggtagcataaacttccgtgcctgcttgccaattattagaatatgatatccaatccattctccatttctccaaagcgaagtccgtattttgttgcaggcttngngataganaactgaaataagttgaagccctgggtaggtaatagctcctgagcaggccactccaaaatttgttggcatagtcatgaagtctgctctggttggtcttcgtgttgtcataccacattgttacttgtgttcttgcattccattgatactgccttctctcgctatcacttactgctaggctttttgcactttctaaccatgtcccaagcaaaaagttgttattagaagcaaaaagctcgtcaatgtcctcgataagatccagaaatttttggctgngaaaatttaatgcttttgcatccttctcttggnatgcagtcatcacatctaaataaacctganttcctagttttganaacac

SEQ ID NO: 5011 - DNA, 594 bp, Musa acuminata
  misc_feature (219)..(219): n = any nucleotide
  misc_feature (224)..(224): n = any nucleotide
  misc_feature (521)..(521): n = any nucleotide
agtagagagaaaattattgtacatgaccgaggaaagttgaaatcttaaaacactacaagctcagtccctctgtcagatgctgaagaaaaaaacaaataactggagaaccaacatatttgaggtgattaatagctcagaaatgtgacgtctacaatatgtcaatgaaaataaccaagaacctgaccgccaacattctgcctgatagcttcctcatgatcnaaganaccattaggtgttgtgattacaacatatccccactggcgtgtcggaagcatgcgcaatctgtagtcttctatgtttctagacttgaggtcctgtctgtatgtaagggctttgcaatcatttatccttccttgcagttccacagtgatccttcccactctatgtggatcaaaaacctgaaagtctttaatatatcctcgatctttcatgatcctcaggaaggagacgatgacggaggaaatgggctggagggtggcggtggccttccccctcctctccgcgttcactatcgtgcggangcatcgttcagaatccttcggcccatctctccctatctccaccaccaacgtaacaagcacaggcggagaacag

SEQ ID NO: 5012 - DNA, 592 bp, Musa acuminata
  misc_feature (364)..(364): n = any nucleotide
  misc_feature (500)..(500): n = any nucleotide
  misc_feature (505)..(505): n = any nucleotide
  misc_feature (557)..(557): n = any nucleotide
attaattcattgaagaacatagatgacgaatagcgataagatacatagattcttgtgcttgttacaagtgccgaggaacgggaattctggtacggttgcggtggtgaagaaggtcgggagtggtctcgtagccggcgaatacttcttcccagatctcggcgaatgctcgaagaattgtgtcatggtggcgtggtgagttgagagcaaggaagcggtggagcagctcccgtagctcctcgccatcgacgatctccttatcgatgatcatctgaagcattgatctccggaactctcccagtgggtccttcgtctccttcaccaccgccacgctctcctccactttccgccctcctccttcactgcngcttcgctgatgcaatctcttcttcaccccttcttttatatgagcgggggatgggagagtgcaccgtccccacgaagtcacgtcctgctccagctcgttcagctggcgcaggagaccgaagaggtgggcgattaancggantctccatcttcacctctcctccccgtaggagaaggtggagggggaagacaangtcatggtgtcgcggacgacagtccctggcctccg

SEQ ID NO: 5013 - DNA, 591 bp, Musa acuminata
gtgttgtcacatgagcaaagaccacaaagacattctcagaaccaaattaaacagccagtaacaacacaacatggactaacttttggacaagccaaacaaagttcaaacaattaccatcataggcttcgacaagcttgcattgctcagatctgcttgtagctttatcttgattgcaccttgatgtcctaaaattagtttgtctgggctgctccatagttgcggatgcttggaggatgtaaaaacaacttgctaaccaccagatacatagaagagtatattacgcttgatttgctcagcacataggtagagtatcagcacggcgaaaccaagtcactcttcgacaacattcaccagttcatattccaccagagataggttattatcctctttcacagtgaaatctgctggatcggtcacttcaacacggccccatttgtccacagcaagtctcatggatcccttgaacatatcaatctttgcattccggagaattaatgtggtccctggcgtcatcatgtccacctgcttcattcctagcagtgacgagaatcatgccagttttcatcaccaaccaaggcattctgcaatacg

SEQ ID NO: 5014 - DNA, 590 bp, Musa acuminata
aaactgtaaatatgctacacggccgttttcagacttggggggctcatatgtataaattccttgaacctcttcttcctttacaccctcaagatggtgtaccagcaacctcccctgggggcggtgatggagaggtcttgatcttggaatcaggctcaggaatatatggctgagatgccacatgattaagggcaacaaccacatcggccatgatgggtcgaaaatggggctgctcttgaagacacatcgagccaatgacaaccaattggtgaaaggcccgtggtgggaagcagccttgaagaaatggatcagccaacaggttgaacttccttctgtcactgagaaaaggtcttgaccaatttgttagatattgctcgcctccaatccttgaagaatcaaaagccctttgcccggtgatcagctccaacagaagcacaccaaaactatatacatcagacttcattgtcaacttgccactcaatgcatagtcaggagcacaatagcctatgttcccatcacccttgtcgagacatgtgtgttgtcgccatcaggcccaagttttgcgagtccaaaatcagaagtttggattgaag

SEQ ID NO: 5015 - DNA, 590 bp, Musa acuminata
  misc_feature (3)..(3): n = any nucleotide
  misc_feature (417)..(417): n = any nucleotide
  misc_feature (582)..(582): n = any nucleotide
tanatgatgacaatgactaaagatcaacttaaccattacatgatgctactcgtgaaactttgcgaggaagcttgacaagtaaattattggaatcattctcttaacgaaatcactaactggagtcgacaagggagggaagagaagtcatttacatggtcaacatcgatgtatggttcgcacttgagcacatggctttttggtcagctatctcgaatcaaattagtaggctcgctcaaaacatacttcggtagttcatattttgcacctctttcatcatagcagagagtcatgtcagcatttgaaataattatgcctgcactgtccactatagcttgtgcaaggtttatatcagcttccgctgcagctcggagtgcatcccatatctcttctcctttggtgggagtggatccagcgcanccatcctgatgcgaaccaaaatccagtcgattgcgatcggggagagagagggtagaaatcagaccatcgggaccctgagtcgtaatgggaaaggaggagcgtagatcgtggtggtcggcgcctcgggctccgtcgaggatctcgagatgggaaggggaaggggcngtggcgaa

SEQ ID NO: 5016 - DNA, 589 bp, Musa acuminata
  misc_feature (2)..(2): n = any nucleotide
  misc_feature (12)..(12): n = any nucleotide
  misc_feature (27)..(27): n = any nucleotide
  misc_feature (232)..(232): n = any nucleotide
  misc_feature (278)..(278): n = any nucleotide
gnagaagtccanagtgaattaaaaccngaacccagtgacacactcctgaccccaggacaacacggaacacagccaagaaaacgacacagaaacttaaagcagcagtggcagcagtagtcgacaaacacaaggcttgcgaacattgctcgcttagtattcatccccttcatcgccttcatcaccctcagcagactctgcgccaacctcctcatagtccttttccagtgcagcnagatcctcacgagcctcggaaaattccccttcctccatgccctcgncaacataccagtgcacgaaggccctcttggcatacatgaggtcgaacttgtgatcgatacgtgagaagacttcagcgacgctggtggagttggatatcatgcacacagccctctgtaccttggccagatcgcccccgggaagaacactgggtggctgatagttgatgccgcacttgaatccagtcggacaccaatcgacaaactggatggtccgcttggtcttgatggtagcaacagcggcattgacatccttgggcacacatctccacggtacataaggcagcaagccatgtatttcccatggcggggat

SEQ ID NO: 5017 - DNA, 587 bp, Musa acuminata
  misc_feature (3)..(3): n = any nucleotide
  misc_feature (15)..(15): n = any nucleotide
cgntgtatcgataanttttattgaacatactgagtttaagctacagggtcgagcattaaagatgaaataattggctgatgtaaaacaacagggcacattacatcattgttaagatgtataaagcctttgaagttggaaaagcatacggtttattagatggacaaaaatgcaacatgatgagcagaatttatctcactcgaatattctccaagaaatgcgatggaagttccttagaatagccttcagagagcctaaaatataacacaaaacttattccttcaccatcggtttcactctgaaatatggtagcaggatagagtggaatctgaatgttaaccacaagaataggtgggaacttgccagatggattgaagatgggaagttccacaaatcgagcaatgtgattaattttctgctgagacaggtagacatcaacaccaaaaggacagtatgctgcataatttggagcaaactctttcttcttatccctaagggtaatgttctccccgcactctgaatgtattgggttcaatgaacgaccagctatcaagcatttctttccagcaagcagaattggacttgagatc

SEQ ID NO: 5018 - DNA, 586 bp, Musa acuminata
  misc_feature (290)..(290): n = any nucleotide
  misc_feature (479)..(479): n = any nucleotide
aatcatcaatccttttactgttcggcggggagaaatgacttgacgaaattgtttacagaatggaattttattgatcaacaccacctttcttttttggagttacagattacagtgtttggttatctaaatctgacaaaggcaactggcttccaaagagaagtggttaaccacccttctcctggttcatggttttgcaagcagctgtttgacgaatgaaagaactccaggaacatcaactgtccatgcaactgatacaggtgaataacctgtccacggattgcttgtgttcnacctgcaagaaatgttgcttcagagagaaaagcattcgactacaagaaagttgactgaagaagaaggctggtgtggcctacctttttaatccttggtccattaatgtatgccccacacagattccctgtgtctcaaccctcacaaccccctttttaaatgtaaaaagatctggtcgaactagtgcgacnaagctgacaggtcatgtaggaaataccataaacaccatcagacttaacatgcagtctctgtagaacttgcacatgtcagataaaatttgtgagtgccttcctgagag

SEQ ID NO: 5019 - DNA, 586 bp, Musa acuminata
  misc_feature (5)..(6): n = any nucleotide
  misc_feature (33)..(33): n = any nucleotide
aaacnnaacaacgacgaccgtagtacatgagantctgctgggacacagcagacgatgcaaagagaaggatgagccaaaagaaggaattcgaaggaacagagtagttagtagccggggggcttgaaggcgatgaaactgatacactgcacttggcggttgttgtcgaagccgatgatgcggatgaaggccttggggtactccttcttgcactcctccacctccttcaccacctgcaccgcgtcggtgcacccgaacatgggcagcttccacatcgtccagtaccgcccgtcgtagtaccccggcgaccggtggttctcacgccccacgaacccctcatggctgaattctaagcagggaatccatttggaacggagaaggtactcgatctgcttcaccaacggctcgtccaccagtgtaggaaggtaggagagggtctcgaacttcttcttgccctcgatcggccacaccttcatgcactggactctgccaccgttgccgggaaggtgggagaggtcggcgttggcttcctggtgaccgggaaggccgaggtggacttgagaccggtgaagggcgcaccatgcttgga

SEQ ID NO: 5020 - DNA, 581 bp, Musa acuminata
  misc_feature (2)..(2): n = any nucleotide
  misc_feature (23)..(23): n = any nucleotide
  misc_feature (537)..(537): n = any nucleotide
  misc_feature (572)..(572): n = any nucleotide
tntcatacacgcagcaatttggnacaaagaaaaggcagcatgaacgaacagttggctgcgtgttgagcactgcaagtgttcgacaaaattgcgagcacttgcggtgtcttcattcgttgtttatgacgccccaaagattcctttgttctttgtgatcactcaacaggaggaaaacacagagcgagaacgacgaagtgatgggggaaggcattggcttcagttgtggcggtcggcgacgtatgagcgagaacgtcgcagcggcaacgcccggacgcaatcgaacccatgtaattctgtctccgcgttccgtaccagcgtccgcgccagctgctgcgccttctccacgccgatgagcttggggtacgtcgtcttgccgctcgccacgtccttcccggccgtcttccccagctcctccgacgtcttcgtcacgtccaggatgtcgtccaccacctggaacagcaggcccacgcagcgtgcgtaccggcggacgcggtccacctcggcgtcgctgccgccgcccacgatcgccccgcacgncgccggcgcctccagcagcctccccgtttgtgcangtggatgaa

SEQ ID NO: 5021 - DNA, 580 bp, Musa acuminata
  misc_feature (265)..(265): n = any nucleotide
  misc_feature (333)..(333): n = any nucleotide
  misc_feature (377)..(377): n = any nucleotide
  misc_feature (455)..(455): n = any nucleotide
  misc_feature (461)..(461): n = any nucleotide
attattgcattgttttggaattttagttgcatctaaaagatgccactatgtaggtgttaaaagtatataaattacattctgtatcagggggctgccatttaccgcgtgtttgggcccaataaatggttatcctattcgatatcttttacagcatcctttgcaagacgagtaacataagctgcggcaagggctgtaaataacagccctatgccaagagtcagtaattgaccatttccccctaacaaccccacatctgactcctctngaattatggctcgcccaaatgcaccagcactaacataagcccaagtccctggaagcattcccaaccancttcccagcacataaggaacaaatttcaccgatgtcaagccatntaaatagttccctagagaaaatgggagtaaaggactcaaacgaggagtgtaacaactctaacaccattttctccaatngcctantcaattgccaaaaacttcttatttccttcgaccatttaagatgcgctcccgtgcaaatacctagcataagaaaggctacagcagcagcaaccgtccactgttgagacatgatggtgcag

SEQ ID NO: 5022 - DNA, 580 bp, Musa acuminata
  misc_feature (5)..(5): n = any nucleotide
  misc_feature (27)..(27): n = any nucleotide
  misc_feature (167)..(167): n = any nucleotide
  misc_feature (511)..(511): n = any nucleotide
  misc_feature (521)..(521): n = any nucleotide
aactnttacaatccaactgtacatganctgtggcaaattacaccacctattttaaggctataaatcaagcaactggaagcaagaaacgggactaaaccctaatttctagtgtattaattgctaagcagatctgatggtggtgaatgtgaagctggtttctgttgatnctctctggttaccttgacaggtgagtccacagaggccgcaataggtggcggtggttgtgcagtaacattgccacttgaagagtcttccccttgcttcaatgacggaattggtagctccgtgagcatctgcaccacttccctcatcgtcggccgccccacgctctgctcctccacgcagagcatcgcgacgtagaacacatgcatcacctcgtggatgggcgcagtcggaagccttgggtccaagatcttggccacattctctttgtcggagcccgtcatcttccttacccattgcacgatgtcgacgccatcaccgaattcaccgaccggcttctaccggtcancagctcaggngcaccacgccaaagctgtacacatggtcttctcgtcacttgagggtgtaagcatactct

SEQ ID NO: 5023 - DNA, 577 bp, Musa acuminata
  misc_feature (3)..(6): n = any nucleotide
  misc_feature (24)..(24): n = any nucleotide
  misc_feature (182)..(182): n = any nucleotide
  misc_feature (218)..(218): n = any nucleotide
acnnnnacatgaatacattatggnaggaaggtcactacaaagttcacccatgtttgacactaaaagccccataaataagcaacatttgactgaataatatgaaatttgtctgagttcatcatcaaacgaaaaacctatctggttgaatccaatagagtcagttcctaaaacataaaaaggcntcaaactattattattggcagtatgtttgacaagcnactcatttcttcttggcagcagcctttgtaattttagcaccggttggatccttcttctcaacactcttgatgacacccacggccactgtttgcctcatatccctcacggcgaaacgaccaaggggtggatactgggaaaaggtctcgacaaccatgggcttggtaggaatcatcttgacaaaaccggcatcgcgttcttcaagaactttggctccttctcgagctccttcccagaccgcctgtcaatcttggtaagaatctcggcaaacttgacagcaatgtgagaggtgtggcaatcaagcacaggtgcataaccattgccgatctgaccaggatggttcatgatgataacctgagaa

SEQ ID NO: 5024 - DNA, 575 bp, Musa acuminata
  misc_feature (2)..(2): n = any nucleotide
  misc_feature (4)..(4): n = any nucleotide
  misc_feature (6)..(6): n = any nucleotide
  misc_feature (25)..(25): n = any nucleotide
  misc_feature (30)..(30): n = any nucleotide
  misc_feature (434)..(434): n = any nucleotide
  misc_feature (532)..(532): n = any nucleotide
  misc_feature (534)..(534): n = any nucleotide
anangnccacatcatttcatgattnttacntaaacctcttaaatcagtaagatacagggattacaagtactggtgaacaacaaaaaagctacactattaagcaaataaattcaatgtaaagctggaactcgagcaccacagcttacagaacaagtgaagcaatcatcgcaaatgggagaagagaggtacaaagtttattaccagcctcaagcacggcgcttactcagacgccaagagttgggttcgtgatatcggtcataaagtggttcgatacgctcttgtcgcttgcgtttactcatttttgtaggatctgcacccttgtagaatcttggagccaactctactaaccacttggggtcaactactgtgacttccctcatgtactccttagtcgtcattacaagctcgtgatatataacccagtctggttgccnttgaaatagagcactgctggggtgaatatacacaggctggttctcaactaaggtcctgtacccttcctggggatctttccttgctgcatggaaaaagnanccccgccgtaattgccttccttatcttagtaaaattttttc

SEQ ID NO: 5025 - DNA, 572 bp, Musa acuminata
  misc_feature (6)..(6): n = any nucleotide
  misc_feature (8)..(8): n = any nucleotide
  misc_feature (19)..(19): n = any nucleotide
  misc_feature (27)..(27): n = any nucleotide
  misc_feature (34)..(34): n = any nucleotide
  misc_feature (42)..(42): n = any nucleotide
  misc_feature (44)..(44): n = any nucleotide
  misc_feature (71)..(71): n = any nucleotide
  misc_feature (91)..(91): n = any nucleotide
  misc_feature (101)..(101): n = any nucleotide
  misc_feature (121)..(121): n = any nucleotide
  misc_feature (134)..(134): n = any nucleotide
  misc_feature (142)..(142): n = any nucleotide
  misc_feature (148)..(148): n = any nucleotide
  misc_feature (154)..(154): n = any nucleotide
  misc_feature (162)..(163): n = any nucleotide
  misc_feature (171)..(171): n = any nucleotide
  misc_feature (227)..(229): n = any nucleotide
gtgatngntcttgaaatcnccatggangatttanggtacacntntgccaccaagattatgaacaaagacanacttttgaacactataatanaaccattacnaccatttgcaagtagcatgnggagctttcttanaaatatanagtggnatccgnacggcctnnaaggctcnacccacaagattacagaagataaagaacctcgcagctcctcatgtgaggaccaggnnntttacgctggtggtcatttgtgtgaggaagacttgcatgcaacaactcaaccggcatctccctgctaatagctctggttgcctcagatcccacaactgcagtgcttggtgcctgcatgagtaacatttgcattatactgtcatatttactaagacagtacttagtaagaagcccaaagaaagcatcgaacgatgcctgccataaagttcgactagagacagtataattgtttgcagcatgagggtctgtcagaagatctgttgctcgatccagaacagactttataattatgctagctccatcaccagctgaacttccagagggcgagaggtggtgtcgatga

SEQ ID NO: 5026 - DNA, 570 bp, Musa acuminata
  misc_feature (547)..(547): n = any nucleotide
ttagaacttcgtagcgaaaatggcagacttcgggctgtccaaagacggtccggcattcgatcatacgcacgtcagtactgccgtgaagggaagcttcgggtacctcgatccagagtacttccggcggcagcagttgacgcagaaatcagacgtctactccttcggtgtggtgctattcgaagtcctctgtgccagaccagtcataaatccaagcttgccaagggagcagatcaatctggcggagtgggcactgcattggcagcggcagaaatcgctggaaagaatcatggatcctcgcctgggaagggaactactcatcagagtcactgaagaagtttgcggatatcgccgagaaatgccttgctgatgaggggaagaaccggccgacgatgggggaggtcttgtggcacctcgagaatgtgttgcagctgcaggaagctcatgtgcagaagggagatctgaattcatcgacgacaagccaggcgagatatgctgcagatgtatcgttcagcctcccgcgcattgtcgagggagaagaggaagcttncacagaaccagaaagcattgatg

SEQ ID NO: 5027 - DNA, 569 bp, Musa acuminata
  misc_feature (5)..(5): n = any nucleotide
  misc_feature (7)..(7): n = any nucleotide
  misc_feature (523)..(523): n = any nucleotide
tcttntntggagaaatacaacgaggcgagtatcttgtactgcctgccactcgactcgagtatcgacctaaaaaaaatgtatggaactacttccccaacacaacaacaatcacacacggctaaatggtgtcaaaccaaaggctgtcatggcatcaaaaccagcctgtgttcaatgatattattccaaaacaattaaattcgacttataccattcccaattaagtggatttctataagcccactgcttgctgagcccttctgaatttgattcaagaatatccacgtcatcatgacgtgtggagcaattcggacacagtagacgggaaatccggtgtagaatttgaaaggcccgccagactttaaggtcttcatcacacagtccaaagaaccagtgtaaggatacttcccagtggcatcaggctgcatcttctgtatttgtgtcttcacataatcaaatggtaaactgcagcagatgcaaagaaccctgaaacagcacttgccccaattacagtgctaacttcacnaaaaccaagagatccctgaatagctcatgctctgatcatatgtgca

SEQ ID NO: 5028 - DNA, 569 bp, Musa acuminata
  misc_feature (138)..(167): n = any nucleotide
tttattactacttaaggatccgaataggatgttttttatgcactatcagctcaagcatacattccacaatgaataaatacaccgtaatcccatcgaacaccacaacagaagaaaagaacgaacagcgccacgacggtnnnnnnnnnnnnnnnnnnnnnnnnnnnnnngtgatgtaggcattcgggcgaacgtgttcagatcacgccctgggcttgcagacgatggtggagtgcttgagtatgtggaggctgaactgaccgcccttctcggtggtgtcgaccttgctggcgcccggcggcggcagcagctcgaagtcctggacgaggcggccgagggtgatgccgaggatgggcagggcgaggatgatgccgggacagctgcggcggccgacgccgaagggcaggtaacggaagtcgttgccgttggcctccaccttggcttcctcctccaggaagcgctcggggcggaactcctcggggttgctccagtgggcggggttgttggcgagccaccaggcgttgacgaggatcttgctctcggcggggatgtcgtaacccgccgagttggcg

SEQ ID NO: 5029 - DNA, 567 bp, Musa acuminata
catgtatagctcattaggatgtacaggtgctatgactagcatatgaacaaaaaagacagtcaaaaattgacctcaactcgaactttcaaatgaaacctgatagtgtgtgaacttttgattctgagttgagacagcagtgatacctcgtaataaccttagaacttcactggtatcttcaacgtagtatttggccttgcttggcttttgaccaactgtacatgcaaagacttcgggaactgatggaaatagattgcttgaagcagtgttgttgatgctctcaaacatgtcctcatcagatcggtcatcaccaatgcacatcacaaagtccggtggcttcccacggttgctcagagtcccaagaagcttctccaccaccagccctttactaactccctgaggttttacttcaacaatatgttgaccccgcttaacaaccactggctcgtttgccagaacactctcaagatgatccagtagtctttagcttggcagggaccaaagtcatgatctgcatattgatgatgccatacaattgcactctcctttacttctacaatgaccatctgt

SEQ ID NO: 5030 - DNA, 565 bp, Musa acuminata
  misc_feature (554)..(554): n = any nucleotide
ggttgcagtgttttcttccttggtgagccattcctgagcagcaacaagatcaggaagcacaatggcaccggactttctccaggtctcagcatccgatgtcttaaatctatccaagagcaaagcatgcataccgacactcctggctggaaggtagtctttgcgcatactgtccccgatgtgcagtgcttccgatgggttgatatttccggccttctccagtgcaatctgatagatccttgggtctggtttttcaacacccactatgcctgagaatacaccaaagtcccattctaaacccctattgagtcctaaggcaggaagaatgacatcttgatatcgatactctgcgttgctgacaattccaacaatcagacctttctggcgtgcccatctgaggaagggttgagagtcaagaaacacagagtagggtgccgaagatccaaatgatgagtatatgcgttgaaaaccttctcaaatgtctcatcatcatattcatagctgcctgatgaaggatcttcacacatgatctccacagtcatgttggattttgctgntgtcaaaacat

SEQ ID NO: 5031 - DNA, 564 bp, Musa acuminata
  misc_feature (266)..(266): n = any nucleotide
  misc_feature (528)..(528): n = any nucleotide
  misc_feature (540)..(540): n = any nucleotide
atcttggaaatattgttccttacaggcaaaagggagttctttgaaagtttgtttacgagtgatagccataaagatgactctgatctccttagtcctgaatgactatggttcatcccactagttccataagaactgtgagtgatctgatgtcccgagtgcttctgaattttccctcgactagaactatccatgttgtctagattggcttccagcttgagcgaatgaaactccaacttttgttccagaatgtcccaatcccagcaatngatttttttctcttataaacatctttaactgctctgaatccctgaggcaaaaaagtatcactctcacagactttgtacaactctccagagtagaacaagcagtgctcaagaggaacgggtctttttgttgtccctgtaacacggatcttcttttgttttgttcgaccaatccaatcagcaaattcaattgtgtttgggaccgttgctgaaaggaggtaatattgacatgtcttggaagcatgatgataacttcctcccacanaacacctctttnagcatattgacataatgcacctcg

SEQ ID NO: 5032 - DNA, 564 bp, Musa acuminata
  misc_feature (11)..(11): n = any nucleotide
  misc_feature (15)..(15): n = any nucleotide
  misc_feature (18)..(18): n = any nucleotide
  misc_feature (45)..(45): n = any nucleotide
  misc_feature (47)..(47): n = any nucleotide
  misc_feature (89)..(89): n = any nucleotide
  misc_feature (127)..(127): n = any nucleotide
  misc_feature (132)..(132): n = any nucleotide
  misc_feature (135)..(135): n = any nucleotide
  misc_feature (141)..(141): n = any nucleotide
  misc_feature (207)..(207): n = any nucleotide
  misc_feature (256)..(256): n = any nucleotide
  misc_feature (287)..(287): n = any nucleotide
  misc_feature (307)..(307): n = any nucleotide
  misc_feature (371)..(371): n = any nucleotide
  misc_feature (496)..(496): n = any nucleotide
aaaaaaaaaanaacnccnaaaatgatcagtcgtataatcattacncnactgatgttttctttccaaaacttcaatgcattatttctagncaataattgaaagattgagaggcaaatgctatagtgtncattncanctgctntctttcttctgagttgaatctgttccaagcttccttaaggagatcgaaaactttctcacaaatgtncttctgttgaatgctggcccccctttgctgtaacttatctggatgaacncagagagtagccctcctgtaagctttctttnctgcagaagatgtgataacntctgtcagttgtataggctgccaaccactctcagggccaaggatatattgcagtgttgatagcngtgcacgcaaatttccttcttttccattcgaccatctcttaatgtcaccatccaggtactctgccaacctatttttctcagcttgctctctttgtgcaagaacatcccgcatgtttttttctgcnagagctttggcagcacgttcagctattctctgatgcctctctaagtctagcttttacaccttaaaagc

SEQ ID NO: 5033 - DNA, 564 bp, Musa acuminata
  misc_feature (7)..(7): n = any nucleotide
gctttanaaaactcatgtcatgttaactaggaggacatgaaatactttgttttaccaactctcgagtttcaaccctaaaacccagaatacaacctactacaatatttttaatcccaaatgccagcttcaaattcaacaaacaaaaacattaattagatatttcgatgactgatctgggtatctagtcttgctgaaaattctatacccaaaacttaagttaccaaatctatctcagggagcggcatctacttgttgtagaggtaaacaatgctgaaaatgaaaaatgccaccatagttgaaaatgatgctccataatataaaaaagcagtcgttatgaatctctcatattcattgtgccggaatggtcggacaggtatctgttttgaaagtgataagctagtgtatccaagtttttggtgctccaccttaaactggaaaacgccatagacatcaggaaccttgaatgaagttgaatacaggcccttgtggtcagtggcaagggtttttagtacataggggctcatcatataaaattggaacttgcacatcatctgctacatatgg

SEQ ID NO: 5034 - DNA, 562 bp, Musa acuminata
  misc_feature (14)..(15): n = any nucleotide
  misc_feature (17)..(17): n = any nucleotide
  misc_feature (26)..(26): n = any nucleotide
  misc_feature (34)..(34): n = any nucleotide
  misc_feature (38)..(38): n = any nucleotide
  misc_feature (120)..(120): n = any nucleotide
  misc_feature (349)..(349): n = any nucleotide
  misc_feature (431)..(431): n = any nucleotide
  misc_feature (449)..(449): n = any nucleotide
  misc_feature (461)..(461): n = any nucleotide
tctgaagtcatganntngaagcggangatatggntatntctgctcagggtcctgagaaggggcacagtaaaacgagagaactggatagtgaagatctgttggagcagttgcctgcattgnagcagttattatatcggcttattggatgccgtccagaaggagctgctgttagcaattatgttgttcagtatgccctagctttggtactgaaagagagcttcaaaatttattgtgctattaatgatggtatcattaatcttgtcgataagttcttcgatatgccaaggcatgaagcaattaaggcccttgaaatctacagaagagctggccaacaggcaacaagtctttntgaattttatgaagtttgtcgtggattggaacttgctagaaatttccagtttccaaacttgagagagcctccacaatctttnctcgccactatggaagantattcagagaantccacgagtggttctgtctccagagagccattggaattcccagaaagactccttctgacatacaagtagaggcagtccgactactgttgaggaagaaaaac

SEQ ID NO: 5035 - DNA, 559 bp, Musa acuminata
  misc_feature (4)..(5): n = any nucleotide
  misc_feature (53)..(97): n = any nucleotide
  misc_feature (224)..(224): n = any nucleotide
  misc_feature (340)..(340): n = any nucleotide
  misc_feature (418)..(418): n = any nucleotide
  misc_feature (454)..(454): n = any nucleotide
  misc_feature (470)..(470): n = any nucleotide
  misc_feature (484)..(485): n = any nucleotide
  misc_feature (489)..(489): n = any nucleotide
  misc_feature (544)..(544): n = any nucleotide
  misc_feature (548)..(548): n = any nucleotide
caanntctgccttctactgttctgacccctgtgaatcattctccgatcgagcnnnnnnnnnnnnnnnnnnnnnnnnnnnnnnnnnnnnnnnnnnnnncccacttccaccaccacctactcctcccctcccctgccccatctgttgatagaactggcttaatccctgaggattcatagctccaatatggccctccggcgagagccctagctccagccccggcaantgctgcccatgcccgcccaacatcgccgcaaagctcacggcgcccagattcccgccgggaaattcaagtccatgcaatccaatcctcggcatgaaaccgcccatcgaccagtcgcngccgcccccggtcgcaagattcgaacttgatggagccgcggcgccggcatgcaagaaaccagaattgagcccacccancgggggcgggcataagccagggtgggagcggctgangttagaagtcaccatnacggccaagtaggnngagnggcccctgtcccgaatgtcgagttctggggaggccggcacgacatgcgccagggngggnatgaggcggaa

SEQ ID NO: 5036 - DNA, 552 bp, Musa acuminata
  misc_feature (12)..(12): n = any nucleotide
aatctcatccanttggacccagaataccgaagcccataacgagagggtgcgggggaagaaaattctttttaccacgaatcatgaaactgcctactgtgagatactctcctgtgggagctgtcttactaacttgatgtggatatacccaccaggcacttgtaacaatttttgactcccatgcttggctgtgacagacagtaaaacatcctgcttgatttaacgtcagaggtggtactaaattatctggcttgtgattcttgatcacagtactagaagctccatgcaggtccgcatgcacatacagatctcccttggacatatatcgcttaactatcatctcattttgttgtgcatcacgaccacttatgatcaaataattttcgctgctgataaaccagttgaatttctcaaaccaatgcactttccgcatatgagaaattgcagcaacagtcttctcctgagcaagttgatgtcgagttttcttctcagcagctttgaaagccttctcatgcgctttaaatgggtttgtcctgcttgttttcctgtcttttc

SEQ ID NO: 5037 - DNA, 551 bp, Musa acuminata
  misc_feature (7)..(7): n = any nucleotide
  misc_feature (11)..(12): n = any nucleotide
  misc_feature (24)..(24): n = any nucleotide
  misc_feature (53)..(53): n = any nucleotide
  misc_feature (67)..(67): n = any nucleotide
  misc_feature (97)..(97): n = any nucleotide
  misc_feature (500)..(500): n = any nucleotide
  misc_feature (526)..(526): n = any nucleotide
gacatcncagnncatacataattnacttactcaccatctggcacctgctcgtnttgctgtgcatgangtggctgccacaagtaaaccaccgaatgangctgctcgacagcatacacagtccccgcagccgcttgatctcctggcttccccatcaccattccagggcctggcacttgcgccgctggcacatagtaatacggaattgcgtcaccgggagcacccacagcagctcgtgtaatccccaggccctcatcctttaactcatccctgggaactatatccaccaggaagtcaaatatgtcggttctggttatagcgccacctatgtcattcttctgcagagttctcctcttattctcttcagtatggatccatgatctgagtgtcagttccagtataaacagttcgcacgccttggcaaagaccacaggggcctcggctgagatcatacggacatcctcatcggccttcatgatcttttttatccgggcgagcggtangctgtgattcttgaagtctgtgattngttctatctccagcatctggttggc

SEQ ID NO: 5038 - DNA, 550 bp, Musa acuminata
  misc_feature (471)..(471): n = any nucleotide
  misc_feature (517)..(517): n = any nucleotide
agcttttggaatgtgatcaacatactgtggcttgatgattgcctttagattgtcctccagtatacgagtaaaataattctgaagctcagagccacggaaatatgtcaagatctcctgccaatcaggaggattattgaatcgacccaagttgggctttaacttcccggccaacactttaagcgcagtggactttccaataccatttgtaccaaccaggcccagaacttgtccgggtcttggaactggcaatctgtgcaatttaaatgtatttggtccataacggtgagttgtatctttgtccaagtccttcggtagattgatgatctgaatggcctcaaatggacatttcttgacacatataccacatccaatgcataactcctcagaaatgaaagcaagttttgaggcaggggttacttctatgcaaagctttcctgttttcacgacggggcagctcttcttgcactcttngcggcacttcttcggcttgcatcggtcggagctaacgtagcgtacnggtcagccgatccgccatgttggagaggacgag

SEQ ID NO: 5039 - DNA, 550 bp, Musa acuminata
  misc_feature (87)..(107): n = any nucleotide
  misc_feature (523)..(523): n = any nucleotide
  misc_feature (542)..(542): n = any nucleotide
ttttaagttccaaacttgatatgttgaggatgacttgacaacaaaaacaaccactaaaacatgcaattatgtggtgtcattatgttnnnnnnnnnnnnnnnnnnnnnacttctactattccaaacacaagtgccacaatcaatagaacaaagaagaagaaagcacaacaagaatctgtaattccataatcatcaactaacctctagggcatcttctttatcatccttttcaccagttggcaacttaggaacttctgcattgttatcatatttggcatcaaccgaagcatatgaaatgcccctgcctgaactggaacctgaatcaggctctcctgattgctgagatgtattcaaagcatgacaatgaggacagtagtaagatatgcgaggataatcttctttccttgccagtccattatgcatatggcagttgccacatatgagcgcatagctctgcgatggtcctcacccacaagcaaatgcagctatacgagcatccaaccacccatcactagcaccagagnctttgtagtgttcaacaancttctgag

SEQ ID NO: 5040 - DNA, 549 bp, Musa acuminata
  misc_feature (8)..(8): n = any nucleotide
  misc_feature (28)..(28): n = any nucleotide
  misc_feature (219)..(219): n = any nucleotide
  misc_feature (233)..(233): n = any nucleotide
  misc_feature (482)..(482): n = any nucleotide
attaccanatagccttatgccaatttangtttgcagacagataacatggagctttcatatgttaatataaacgtagatagagaagtttacttggtgagggattcacatgttggcattgggctttcttatgctgcacttgttctcttctcgctgcatactctctcaggaatctttcttcgagaaaatgatccagatccaagcaaatatttggaaaattcnccaggatgaaaacnttgacaaactttgacatcgaagatgttctccactcaagtcagataggcaagacacacaatatacatgtccacaattaagaactgcaggctgatacaacatttccttgcacaaagaacaagatacatcatccacagatatattcctttttatggtatgatcaaggcaattttctgacagatctgagcgttcaaaatctccacttctgcaatcattaaattttttgctagaactcccattaccaaaatganaacctccaactctaactgatctgcaaactgaggtgagtacactcagcagccttttcttccactagat

SEQ ID NO: 5041 - DNA, 549 bp, Musa acuminata
  misc_feature (12)..(13): n = any nucleotide
  misc_feature (23)..(23): n = any nucleotide
  misc_feature (416)..(416): n = any nucleotide
  misc_feature (547)..(547): n = any nucleotide
ctgcagttttcnngtcccatgantctttctcctttacaaatgatacaagctcaacctcataaataacagtggagttggcaggaaccacagcaaggtcctgctttgattcagtggacaagaaggcatattcaggtggaattgtcaccaaagcaatctctcccttattcatcgtcatcactgcttggtcaagaccttcgataactttttcttcagcagtcttgaactcaaatgattcctgctcatcatgacccttcttcacaaaaattgtcccatcttgtagtttcccaatcagtttcactgtcacaactgctccttcatttgggtgatcataaccttctccttccttgaggatcattttaatgatcttcttgtcatcccctatctgtgtaacagtcttccaagagactaactcaagntccacataaagatttgcatttggtggcacggcaccttcgtctccagaagctggtctacctttctcaccaaacgcatattgtggtttcacagtgagaagcactttttcagccctcttcatagtctttacagntt

SEQ ID NO: 5042 - DNA, 542 bp, Musa acuminata
  misc_feature (9)..(9): n = any nucleotide
  misc_feature (151)..(151): n = any nucleotide
  misc_feature (375)..(376): n = any nucleotide
actgttttnctactgaaacaatttcaaagaggtagaaatttgaagggacattacataaataaatgaaagtttcattatgagataaatctcatggagctgctagaatgtgaacaacctaagtacagacaagtcaacttgttggttgtcgggnttaatatcattcataaatggggagatcgaaaggtctctttcctagagaatcttctaagtctgttcctgatgtgggaacgcgttgcaagcacctatcactgctgtctttcttcattttcaagaataaactgtgccatcgcaggtcagtagtcagttcagggtgaaaagcagtccccagtaagttcccttgccttactgcaacaattactctctcacgagaaactnnattcctcctcctggccattgtcaacagacattatactctttttcgtttccaaaggaacagggcaatctgttaatatctcgacatcaggtcctacttctaagatggtggtgacgtataaagctccacggaaaccattaggcccccttccctcctctgcaagcttggg

SEQ ID NO: 5043 - DNA, 541 bp, Musa acuminata
  misc_feature (2)..(2): n = any nucleotide
  misc_feature (480)..(480): n = any nucleotide
  misc_feature (482)..(482): n = any nucleotide
  misc_feature (501)..(501): n = any nucleotide
  misc_feature (506)..(506): n = any nucleotide
cntaactctttaggtcatatgagcaggttaatttggatccttccatccatggtcaagaagcacatcacctgaaataggcaacgcctgcctcatcactgtgttttttgttacttggagactggtgggggttcgctggtcgccgtccgttgcctatcgaggagctccctggccaatgcctggagatcgccacctccaaacccagagctctcagaaaggttcctcgtgctggtgctgagctgctgctgaagaggccatgctggctggaccagagggtcaaacagtgccgacaggtccacggtggaaggcaggttcgcggccgatggcaggtcggatatcgagaagggcatcgatgccacgagcgacggcggagggggtggcggaggaggggacggcagctccaacgtggccagatgggcttgtaagtaggacagctctgcctgcaggttgactacctgttgttggagggcgaagatgtgagcnangcagccgtagacggggtcncgganggcgcgcctgggccttcgtagcagatggtaaccga

SEQ ID NO: 5044 - DNA, 539 bp, Musa acuminata
  misc_feature (23)..(23): n = any nucleotide
  misc_feature (48)..(48): n = any nucleotide
  misc_feature (93)..(93): n = any nucleotide
  misc_feature (154)..(154): n = any nucleotide
  misc_feature (307)..(307): n = any nucleotide
  misc_feature (384)..(384): n = any nucleotide
  misc_feature (497)..(497): n = any nucleotide
  misc_feature (506)..(506): n = any nucleotide
ttcgtggagtaggccaacgggancatcatattgctttcaatgacaggnggggacgtacgaccgtcaaatacagcaaccaaaaaccatgcaggnacaaacatgaagactaattgggtgaagacacgatgacacagtctttgatcactcatcaggncactcgaagtcggatggcacttccttgccgcagtcagcaagaacctcgagtgcaggggaaagaaggatctgtatgttcaaggcctgggccttgatggtggcgcacagacacagggcggcgtcgaggtcggagagcccctccagcaccgggcancactggtaactcacgccctcgccgatgatgatgtgcaccagccccccgagtaggtccacgcacgagtcgagcttagnggtgtcgatggggcatgtcggagtcgtcggtgatggagggtatggagtcggggttggtggcgacggcgttacgtatgctggtggtggagggtttggagctgtgtacgttggtngtggtggtngtgaagggcttggagtagtatacgttggtggcg

SEQ ID NO: 5045 - DNA, 533 bp, Musa acuminata
  misc_feature (2)..(2): n = any nucleotide
  misc_feature (305)..(305): n = any nucleotide
  misc_feature (522)..(522): n = any nucleotide
anaagtcctgtttcatcatttcacttgttcaagtacatttagataaatctcaatgtcactgtcgaacaagttcaaaatatcaaatggcgtctcataacatgtttcatgaagcaaacgttgccagtgtcacccaacatagaacaataacttcagatgaaacttggacaaacaggtccttttgatatgccaaggcgaacttccatcccgtgatgcatgtccagtggcttgaatgtttccgagtcctgtggcaagttaaggtaatcttcaaaagcaaaatcatccaagccaccagtgagagcctcaanatcctagcatggaagagggcaatgctccgggaggtctttggaatctggagagaatttgggcatcgagatctctcctcagattgaaagccgttccgtagtaaggtccaaccccatccgttcttctcctcccagattctacccgtggattcgcgaagggattgaaggggatgggtccgacaacgtcgcccttgacggcgtgcacccgaagcggagggcntcgtggttcgc

SEQ ID NO: 5046 - DNA, 530 bp, Musa acuminata
  misc_feature (2)..(2): n = any nucleotide
  misc_feature (4)..(4): n = any nucleotide
  misc_feature (6)..(7): n = any nucleotide
  misc_feature (14)..(15): n = any nucleotide
antnanncaaaatnncttgcagcttcatttacatgccctcatctctgtcctgtcttaccctaaaccttcactcttcagcgacgccactcttcgatccatcgaaccaaagtcacttgctgcagtgggcgtaaaggaagccgtcgacctccgtagcccccatcagagcactcgccagctgatctctctgcaagtgcgcctccaaaacctgctcttgcaccgctctcagctggccctgcagctcctccacgcacctctgcaggcacagaacgattccagcgcatccatacacggggtcctgcagccttgcatgagcttcgtacaccatgctctttattgcgtcctccttcatcccttccttcaccacttgaagcatcttgacgacgttgctggctccgaacaccttgtgcacgctggcgaacttgtcgggctcgtcggccggaaagtacggcgcaacaggcatccgtggtcgcacttccggtgcagcgttcgacaagcagcgcagggaagatcagctcgcccgttccataaca

SEQ ID NO: 5047 - DNA, 528 bp, Musa acuminata
  misc_feature (212)..(212): n = any nucleotide
  misc_feature (505)..(505): n = any nucleotide
agctatcacaacagagtacttgaggaggaaaggacacaaggaaagagaaaccatgacagcacccttgttcggtgttggctgctcctcctcccctctgtttcccctctccaccatcatcatctttattgctactattaatttatagtaatgatgaagattaatctgtaattaaccaacaatataataatacacggtcacgtatgatgattgcntcaggccgacgctgccgctcgctcctctccggcgatcttgcgcttcctgttgatcctcttggtggtctccacgccgtagtactcgacgtaccacttcacgaacttcttcagcccggtggcgaggtcggtggtcggccgatacccgaagtccctctccgccaagctgacgttggcgtgcgtgaagggcacgtcgccgttctgcggcaacgtgacgacgttcttcttggctttcttccgtagcaggtcctccaagatgcttaccatcttggcactggaacagggagtgttgcgangttgttatccgagttggcgggcc

SEQ ID NO: 5048 - DNA, 527 bp, Musa acuminata
  misc_feature (2)..(2): n = any nucleotide
  misc_feature (10)..(10): n = any nucleotide
tngacaaagngatataagttgtaatcatgataaataacattggatgttctgttcttccagctgacagttttccctagttatcatgtccatttccttcaaaagataaatctctcttgcagcactagatgaactaatccccctaatcctaaaacccattctggtacattatgtgacagcaaatacaacatgttgtatgagacagtggcacggcaaccatgcaacattgatcgcccatcgtgatggtcgaaatctgagggtcgacctggagccgaccctaaatcatcaggattgttcggataagcaataactctggcaattagttcactttttactcgagtttaaggacccatccttcattagtcggacactcagactgttgaatcttcctctggagtagtgccgtgaagccttcctccaatctgtcccagtcttcatcattgcgacaaattcgtcatagctgattcgcccgtccttgtcgctgtcaacttcttttaagaaatcatctgccacgtccgtgctatcaggag

SEQ ID NO: 5049 - DNA, 525 bp, Musa acuminata
taaataagaacatgactagctttgatcgaggttgaacagtgtgggagcaaaagaagacagcagcgtagtacatgacagcagcgtttctttatgtacaggcggccaacgcaaccgagaagagaaggcggggagcggcggcgcgatggaccgaatcacaagttgcgacagaggcaacaaggagcccaatcgaagagggaggcccagatgtcgccgtgccctcgcctccgcctccgcctccgccgctggatcgccctgcccgccggcgaaggacgccgtcgggtctcggagtcggccttgcgcaggatctcccacatgacgcgcacgtcctcgtactcgcacgtcctcacctccttccgtagcttcttcagcccggtcctttggtcgccgagacgggtggcgaacgattccacactcgacgcgccgggaacaccaccacccgctcccaccacgccatcctaagtcccttcccctcttctcttcctccgacgagagagaaagagaagagttgccgtccctggtttggag

SEQ ID NO: 5050 - DNA, 525 bp, Musa acuminata
  misc_feature (498)..(498): n = any nucleotide
  misc_feature (507)..(507): n = any nucleotide
aacagtatcgtggtatttgttacatgcgcatgatcacatctcagaagcgaacaccgtgctaattgatgtgctcttcgtggaacagttcgattacagagtgccgatccccggcgtggatagttgcagcgccatcgcgggactgatgggggcgaaggcggagggcggtctgcagatgaacggcctgccgatcaacatgtacgcgccggagacggtgggctgcgtggtggtggacaacaatgggtggtgcgccgccgcgacgtccaccggcgggctgatgaacaagatgaacggccgcatcggggactcgcccctgatcggctccggcacctacgcctgcgacgtctgcgccgtgtcgtgcaccggcgagggcgaggccatcatccgcagcactctggcgagggacgtggcggcgctgatggagtacaaggggccgagcctacaggaggcggtggactacgccatcaaggagagctggacaaggtaaggccgggtcatcgncgtgtcagnaatggcgaggtggcgtac

SEQ ID NO: 5051 - DNA, 522 bp, Musa acuminata
  misc_feature (8)..(8): n = any nucleotide
  misc_feature (11)..(11): n = any nucleotide
  misc_feature (461)..(461): n = any nucleotide
tactactnatntcagcactcgagtagctggaacaatcggttacttggctcctgaatatgcaattagagggcaagttacacggaagtctgatgtgtacagctttggcgtgcttctactagaaatagtcactggccggtgtaacacaaacacaagattaccatatgaggatcaatttctacttgagaggatatggtcgctatatgaacgtggtgagatgacgtacattatagacactgatttggctgatgatttagatgttgatgaagcatgcaagttcttgaaggtcgggcttttatgcacacaggacgctgcaaagctgcgcccttcaatgtccgatgttgtcaggatgctgaccggtgaaaaggatgttgacttagaggaaatcacgaagcctggtctacttggtgatttcttggaccttagaagccagaagagaactgatgacatccatgttccctccntcatatcctccggtcatgatagttcaccattgttatcagaaatactacacttgcatccatg

SEQ ID NO: 5052 - DNA, 519 bp, Musa acuminata
  misc_feature (23)..(23): n = any nucleotide
  misc_feature (312)..(312): n = any nucleotide
  misc_feature (314)..(314): n = any nucleotide
  misc_feature (453)..(453): n = any nucleotide
tatagtcaccttcaagctcatancacttcaaagaggacactgtatgccactataaaaactaagtaacttatcgtcactcttagacctgataagctctgatttcttgtttgcaccttcttaaacacaaaagctaattgctgcttaacctattggctggagatcacaaagcttggaaagagggaagggaggatgaaagatggaacctccgagtacagccccggttactagtttgtttgcagcttctgtggcatgaatcccatcccagctcacgtagttttgtggatctccacaagcagttgcagtcaccttgangncatttatcaccttgctgtttccacagaaaacctgtgggtcgaagttataagcaccacctccatgtccgcagcaagctttggttccgtagacgagtccgtggtttttgggatgtcgaaagagctcgagcttgacagagtnaggtatctacatatgtgatggtgggcatccggaagcatgtctctcatgtgttggagagtgtcattc

SEQ ID NO: 5053 - DNA, 519 bp, Musa acuminata
  misc_feature (6)..(6): n = any nucleotide
ttatcncttaaatcatgttcttgcccttgtatgacaatacagtactccaatagagtagaagttgtagatgagtcgtgtttctagtaggttttagaaaaaattactcgagtagcatttccacatcaactatgataaagcaacccagcttcgatcggaatggtgcagcatgacagtcatctgatggaaataacacagctcaatcgagaaagattatcatggatgagctgcgattgtcattcttcagcagcactagcagcacttagatccacgctgagatcaagagtctttccagtgatcatggtatacatggacagcacgtccatgacggttgactcaaaatgggttgtagcatcataactagttgagatgaagcaattatccagcgagggttcgttgacaggctcatatatgtcataagtctcaaaaaatagctcatccacaggcccaagaagatcaatcccaggctttagttccacttctggcctatcagtctcagcttctgttaagacaaaggcgata

SEQ ID NO: 5054 - DNA, 518 bp, Musa acuminata
  misc_feature (3)..(3): n = any nucleotide
  misc_feature (437)..(437): n = any nucleotide
ganttccattactcttctttcctaatcacatcaagcattatggtttatatatacatacatgtacatttcttggtatggtcttcttgtttctgctgcaagtcgccttaaaccaagatcacgggccatcggtgaagggaactccggtggccggcaaccagctacctccagatagcaaacccctcacagtaaatctcagagcagtcgatggatcggtgataacatggtggccgcgccacctgactcgcctggaagtgtcagaccccggccctgtgttcttatactccccgtagtataacgtgttgagagcgaacccaccgctccattccaaccacccagctgcggagatcagatcatccatgtacgtacccatgaacacagttcgagagtaggcctgccatggccttcccaggtacgtccggaacttcccctgaaccggnctcaggtcggcgcggcgtcaccctgcagtgtggataacgatgccggtgttctggctgggatcggtccgcccctgcgcggta

SEQ ID NO: 5055 - DNA, 516 bp, Musa acuminata
tggtctacagtttacatgactatatattacaggaaatatggaaagaaataaaagaatgagagctacgaggaaaagcatgataaccaacagagccatagccttgcaagttgccacatacagaaatatcatgaaagaatctactcatcaaattggatactcagattcatctaaaattgcagcctggttaaagaaaaagcaagatgtcccataaaaccgccagaactaatatgacaattcatgtccgcgtattgatatatacttcttcacccatatggcgatatcatcagcacaggctagtgcctgaggtgtcctgaggagcatgtctagtgtggcaaactcatgaactgcatccttgtattctaggactggtgcatcaacattcacttttcggagcgcctcggagtatgcaattgctcgatccctcatccagtcatgttctgcaaccacagtgagggttggaggcatgcatttcatggtggtcccacccagaaacaacagggttgcagccggatggtc

SEQ ID NO: 5056 - DNA, 516 bp, Musa acuminata
  misc_feature (20)..(20): n = any nucleotide
  misc_feature (22)..(23): n = any nucleotide
  misc_feature (44)..(44): n = any nucleotide
  misc_feature (53)..(53): n = any nucleotide
  misc_feature (58)..(58): n = any nucleotide
  misc_feature (126)..(126): n = any nucleotide
  misc_feature (132)..(132): n = any nucleotide
  misc_feature (151)..(151): n = any nucleotide
  misc_feature (163)..(163): n = any nucleotide
  misc_feature (173)..(173): n = any nucleotide
  misc_feature (181)..(181): n = any nucleotide
  misc_feature (193)..(193): n = any nucleotide
  misc_feature (348)..(348): n = any nucleotide
  misc_feature (405)..(405): n = any nucleotide
tcatctgagttctttatgtncnnaatcattcacttagacaaacnaaagaaggntaganacaaccttagaacacaagcagcagaccgttcagctcccactctattgtgaatgaatcctggagctgantcaacntgcaaacatatgttcctantgcataacttantagaccaacncatccagntctctcgtcggntcagaaagcggctgaactcgttcgacggagttgatgctttggttcgggctggggaatatagtgtatcatagcttccaactccctttgctgtctcaacctctgattttcttcttcaagtctggagaccttgttctccagctcattcatgtaagccngcttcctagctcgtgaacgggcagctgactcacggttcttgatcattctcttctgcntcctctcgacagtcttcttcgtcgtgtcctccgaaggccccctcttccgccttggtgtttgtggatcaagtggggacaaactggctcttcaccatcacggtacctcgagtc

SEQ ID NO: 5057 - DNA, 514 bp, Musa acuminata
  misc_feature (81)..(81): n = any nucleotide
  misc_feature (205)..(205): n = any nucleotide
  misc_feature (330)..(330): n = any nucleotide
  misc_feature (463)..(463): n = any nucleotide
  misc_feature (503)..(503): n = any nucleotide
caattagtaaataaactggtaaccaagaaagagcataaacctaaaggcttaagcttattcgtacaataggattgcttgagnagtaaatttgagctgtgaaaggggaccaccttattttctccaaaatggtggtgcttattacaagcccttctttttggaatgccagttttcgatactactaaaccaattccactggaaacataancccatgaagcgcatgaatccggcaccaagcacctcagctaatgcagtcaagaatgagctctgtggggacaaaccagctgttgctatagatagcatagtcccctcgaagttgcagggaacaataanccttgaagatttgatgccatctaaagcttttttagcgacatcatcggccttcataccaccagaagaccctgctatgatattggtgagatctggccgcctcctgtgctcttcggcaaaacctggagtctctgtntctggaggaaatatcatggacactgaatgtcgtcagcaangacctcatgct

SEQ ID NO: 5058 - DNA, 513 bp, Musa acuminata
  misc_feature (2)..(3): n = any nucleotide
  misc_feature (6)..(6): n = any nucleotide
  misc_feature (9)..(9): n = any nucleotide
  misc_feature (22)..(22): n = any nucleotide
  misc_feature (28)..(28): n = any nucleotide
  misc_feature (48)..(48): n = any nucleotide
  misc_feature (64)..(64): n = any nucleotide
  misc_feature (93)..(93): n = any nucleotide
  misc_feature (105)..(105): n = any nucleotide
  misc_feature (108)..(108): n = any nucleotide
  misc_feature (121)..(121): n = any nucleotide
  misc_feature (124)..(124): n = any nucleotide
  misc_feature (153)..(153): n = any nucleotide
  misc_feature (157)..(157): n = any nucleotide
  misc_feature (173)..(173): n = any nucleotide
  misc_feature (271)..(271): n = any nucleotide
  misc_feature (289)..(289): n = any nucleotide
  misc_feature (293)..(293): n = any nucleotide
  misc_feature (312)..(312): n = any nucleotide
  misc_feature (322)..(322): n = any nucleotide
  misc_feature (362)..(362): n = any nucleotide
  misc_feature (382)..(382): n = any nucleotide
  misc_feature (411)..(411): n = any nucleotide
  misc_feature (430)..(430): n = any nucleotide
  misc_feature (435)..(435): n = any nucleotide
  misc_feature (441)..(441): n = any nucleotide
  misc_feature (443)..(443): n = any nucleotide
  misc_feature (447)..(447): n = any nucleotide
  misc_feature (459)..(459): n = any nucleotide
  misc_feature (463)..(463): n = any nucleotide
  misc_feature (479)..(479): n = any nucleotide
  misc_feature (481)..(481): n = any nucleotide
  misc_feature (486)..(486): n = any nucleotide
annccntanaaatgaaattgcnatgtgnctaagttacctacggatgtntgcatgcagtccaggnacactttggggtaaacacccatccaaacnactccaacaagnaanggtagaaaaaagnaancttctcttccattgagatcggagaatttntgtnggaaatcaggtttgcnatttccagaaaccacacgattatatagaaatagggcatacgctgcgcctaatatcatcccaagcgctgctaatgtggcaactaagctatttctttggnaagctcctactaagattnaganttccccgataaagctgctngtgccaggtnaactcatattagccaaagtgaaaaagaggaaaatggtagngaaattcggcatggtgctcnctaaacctccataatatctaacaagtcgngtcttatgtcggtcatctngaacnccaacncntagnaaaagggctggngaanccagtccatgacttancntcagnaaaatgctacctccaattccctgtatg

SEQ ID NO: 5059 - DNA, 513 bp, Musa acuminata
  misc_feature (246)..(246): n = any nucleotide
  misc_feature (295)..(295): n = any nucleotide
  misc_feature (334)..(334): n = any nucleotide
  misc_feature (497)..(497): n = any nucleotide
aaacaactatagtacataatttgggagaatcaaagggggagagggggaaaactagaatcctttactgttgctgttggttgagaatgcacatgctacgactgcaaactccactgtactcagttttgatactgtttgaatcaaggttagatgggtttcctacaatgatgttctgtttgacacggcaaactggattctagctatgaactcgtcgatggtcatcattccaagttcacctccaaacctcgntctgacagtaaccatctgagtctcgacttcttttggcccaacaactgcnatgagaggcaccttctgcttttctgcatttcttatgagnttcggtaggcgtcgccgtagcaaagctcagctcggatgccaatggaatttagctttgataccacctccgtgcagtacttgacctcagtatcagtcacaggtaaaacacgagcttggatcggggaatccacagtggaaagtcaccagcataatgttctataggncaccaaaaatctctcc

SEQ ID NO: 5060 - DNA, 504 bp, Musa acuminata
  misc_feature (29)..(29): n = any nucleotide
  misc_feature (83)..(83): n = any nucleotide
  misc_feature (179)..(204): n = any nucleotide
  misc_feature (380)..(380): n = any nucleotide
  misc_feature (415)..(415): n = any nucleotide
  misc_feature (420)..(420): n = any nucleotide
cacccaagcattacatctttaatgcgtantcgtacactatcctcgttgcaccttatgacttggctatatagagatcatctccngccattgctgcttactggccgcttgcagcttagtgcatgggggggtggccgccctggacatgggcgccaaatcctaatcccggaggaggtcccatnnnnnnnnnnnnnnnnnnnnnnnnnnaagcgcgagcctcggccgtcgtgggctgcagctgctgcacctgccgcttgaggaacttgacgtagcgaatggcctcgtcgagcatggtggcggtgtccatcttggtgccgccggggacgaggcgctgcaggatgcggaagcgctcgctgatccgctcgcgccggtgccgggcggcnacgctctgcgggtcgtcgctgatgcgcacgttgcncgccngggcttcctgatggtggcggggtcgacgtccaccggctgcatggcggcgatccggtacatcatctccttcacgggcgcccagag

SEQ ID NO: 5061 - DNA, 503 bp, Musa acuminata
  misc_feature (463)..(463): n = any nucleotide
gcagagtgtaagcataaatagcacataaatctcaagaaacttcaaatgacaagtaaacactatgcagcatatttaagaagcagataattgacactgacccaatcacctgtgaagtcagcagtttatatgacaccagcaaaatataaaaggcaaaagctctactctgtgttattcacgacaagagctatatcgcaggatgatacccaagattaaaagtcacttgtgcttgagtatttcttgtttgacccaactctcgacagcattccagcgaaagccgcagagcagcagccattcccagcaggatgagaacaccagttatgatgttcaccggacgtgaagaaattccaagagaaactgatattagtacatccaacataagtcctccaattataatggcaaatgcaacccaaagtgggttcaaccatcctctttcattttcttgttgccccctgttgtgacctgnatttaccctccaaatccagtaacttgtacttgactggggt

SEQ ID NO: 5062 - DNA, 499 bp, Musa acuminata
  misc_feature (7)..(7): n = any nucleotide
cgagttntcaacaaattccgcctcggtcgtaaaatcgggagcggctcgttcggggagatctatttaggttctaatgttcagtcaaatgaagaagttgcaatcaagctagaaaatgtcaagacaaagcacccgcagttgctatatgaatcaaagctctacggaatccttcaaggaggaactggtattccaaatgtgcgatggtttggcatcgaaggagattataatgttcttgttatggatttattgggtccaagccttgaagatctatttaacttttgcagtagaaaactctctttgaagtctgtccttatgcttgctgatcaaatgatcaaccgagtagaatatgttcactctaaatcttttctgcatcgagatatcaaaccagataattttttgatgggcttgggcaggcgagcaaatcaggtctacattattgactttggattggccaagaagtacagggacaccacaactcaccagcacattacttacaggagag

SEQ ID NO: 5063 - DNA, 498 bp, Musa acuminata
ttaaaaactcctagcttgatatttgaatatgtgaacaacacagattttaaagtcctataccctacattgactgactatgacattcgttactatatctatgagcttcttaaggcactagattactgtcattcacaaggtatcatgcatcgagatgtgaagcctcacaatgtcatgatagatcatgagcttcggaagcttcgcttgatagattggggacttgctgagttctaccatccaggcaaagagtataatgttcgtgttgcatcaaggtacttcaaggggccagaactacttgttgatttacaggattatgactactccttggacatgtggagccttggatgcatgtttgctggaatgatatttcgcaaggaaccttttcttttatggacatgacaatcatgatcagctggtaaaaattgcgaaggttcttggaacagatgagttaaatgcttacttgaacaaataccgtctagagcttgatccacaacttgaagc

SEQ ID NO: 5064 - DNA, 498 bp, Musa acuminata
  misc_feature (3)..(3): n = any nucleotide
  misc_feature (5)..(8): n = any nucleotide
  misc_feature (10)..(15): n = any nucleotide
  misc_feature (18)..(18): n = any nucleotide
  misc_feature (22)..(22): n = any nucleotide
  misc_feature (28)..(28): n = any nucleotide
  misc_feature (38)..(38): n = any nucleotide
  misc_feature (59)..(59): n = any nucleotide
  misc_feature (202)..(202): n = any nucleotide
  misc_feature (350)..(350): n = any nucleotide
aanannnntnnnnnnaanaacncaaacngaaaacaacncaatggtcatgtttggtgacngaatttatacaaccacaagtcttgcatgttacaaaagatttttgccaactttacctccagaatctctcagggactaacattagcacaaaaacagtctaagaacagtatgcaaagtcctccaagtgatggtgcaaattagagcnactaaattggatttcacagccagatgaacattaagctaaaattcgaaactccaagtgagctgaccaaaacattgcactctgaatgtcagaggattgtgcaaccacatctgttatgctttggggctttcgatggttgcttctcattgtncttgtcgagtacaggaggtcgaactacaacatgcatggtaattacaccaccaggaagctcaccaactggtaccctagactcagcaatggttcggttgttctccaatattttacccgcatttatgagcttcacgtcattgattgtttag

SEQ ID NO: 5065 - DNA, 497 bp, Musa acuminata
  misc_feature (8)..(8): n = any nucleotide
  misc_feature (13)..(13): n = any nucleotide
  misc_feature (20)..(20): n = any nucleotide
  misc_feature (33)..(33): n = any nucleotide
  misc_feature (113)..(113): n = any nucleotide
  misc_feature (129)..(129): n = any nucleotide
  misc_feature (146)..(146): n = any nucleotide
  misc_feature (172)..(172): n = any nucleotide
  misc_feature (301)..(301): n = any nucleotide
  misc_feature (305)..(305): n = any nucleotide
  misc_feature (443)..(443): n = any nucleotide
aattcgcntcctnacgagcngctgacttgaccntcttacggagctaccccgtcgtcgggaacctccctcacttcgtcaagaaccggcaccgcctcctggaatgggtgacgganctcgtcgccgcctccnccaccgccaccgtcacngttgcccccttcgtcttcaccgccanctccgccaacgtcgagcacgtcaccaaggccaacttcggcaactaccccaagggcgacgctgacgtcgccaccctgcacgacttcctcggtcgcggcatcttcaactccaacggggccgattggaagtngcancgcaagactgccagctttgagttcaacaccaggtccctccgcgccttcgtcctcgacaaggcccgccgcgagctcgttggccggctgctccccctcctgaacagggctagccggagcggcgacgtcgtcgaccttcangacgtgctcgagcggttcgcctttcgacaacatatgcagtttggtgttcgggat

SEQ ID NO: 5066 - DNA, 493 bp, Musa acuminata
  misc_feature (47)..(47): n = any nucleotide
  misc_feature (92)..(92): n = any nucleotide
  misc_feature (219)..(219): n = any nucleotide
  misc_feature (443)..(443): n = any nucleotide
  misc_feature (455)..(456): n = any nucleotide
  misc_feature (477)..(477): n = any nucleotide
tccgatttattgtcgaatctgacttttacgatttgatattgcaccgnagacatacatgtttaagtatgatactgtgcatgggtcatggaagnatcacgatatcaaggtgaaggactccaaaactcttctgtttggcgagaaacaagtcactgtctttggaattaggtagtcttcttcttatcctttctgatatagatgttagtaatcattatgtttganacactgcccttgtttgtgtaataaagctgttctggtctttaggaaccctgaggagattccatggggtgaggctggtgctgagtacatcgtggaatccactggtgtttttaccgacaaggacaaggctgctgctcaccttaagggtggtgccaagaaggtcattatttctgctcccagcaaggatgctccaatgtttgttgtaggtgtcaatgaaaacgagtacnagcctgacattnncatcgctcgaatgcgagctgnaccaccaactgtcttg

SEQ ID NO: 5067 - DNA, 484 bp, Musa acuminata
cgcatatggggatcggcctgatcttatgcagttggttgagacattgtcacaaaaatttgaatcattgtatgagaaagaggtgcttattctagtggaaaaaattgctgatcatgtgggtaatgagcctttagacactgaaaagcggaaagaattgtataatattattcttgcagcaaatgaaataccgaaagctccttgggaagagggagtttgtaaagtttgtggcattgacaaggatgatgacagtgttttgctatgtgattcttgcgactctgaataccacacatattgtttaaatccccctcttgctcggattccagaaggcaactggtattgtccatcatgtatcaggattcaatccaagaagcaggatctagatcaacacacagaagttaccaaacgccatatgaggagacatctgggagaggaaggtcgtgcttttcaagaggctctgtatcagctagcatgcacaatggaagaaaga

SEQ ID NO: 5068 - DNA, 467 bp, Musa acuminata
  misc_feature (10)..(10): n = any nucleotide
  misc_feature (18)..(18): n = any nucleotide
ttgctaaaanacctggangaaatttctgttgagaagctgcagtcacttcttgatcttgctttgcgttcaacagctgctgcttcagatccatgtcacgaggagttgacatgttgtgtggaaagagtttcattgctcaaaagactaagcacacttaaagatttggattccactgaaccttcagaaggtaatatacttcctgattctgatcctcagtctgagctgttcagtatcactggcttggagacattctgccttagttacaaggttcaatggccattatcactaattattccaagaaaagctctaacaaaataccagttgattttccgtctcctgttccactgcaaacacgtaaaccgtcaactttgcatggcctggcaagtacatcaagggtttcgtgccatcaacattcttggaacggccatcctcagatcttctatctttgtcgaagcatgattaaattatca

SEQ ID NO: 5069 - DNA, 466 bp, Musa acuminata
  misc_feature (356)..(356): n = any nucleotide
  misc_feature (424)..(424): n = any nucleotide
  misc_feature (458)..(458): n = any nucleotide
tgtacaaactggtattttggtgccatatcagttcaacaaattgtcaaaacattagaatttaaaatcttgaaataaacaattgatggaaaagtcaaaaactatgttttcaagagggtgatgtcaaaaagaattaatgatatctaaactttccagcaagtgttttccagaaaaaaattacaatatctcatatcagaaacaacataccatgatcagagcagaagaaaccttggcggcaccttgaaacaagaatcaacactattcttattttgagcaggagactgaactggcactggctttcgagtgtttgcagacacaatgttcgtaactggttctcagttgtatgtttacctgtcttncatctttaatagtggacagaatactaaagttaccaggtgaaggaccggtagggcatatgatttactcnagcatgacaacttcaacatgaagcacatttggcngatgtagc

SEQ ID NO: 5070 - DNA, 463 bp, Musa acuminata
  misc_feature (2)..(2): n = any nucleotide
  misc_feature (5)..(5): n = any nucleotide
  misc_feature (8)..(8): n = any nucleotide
  misc_feature (10)..(11): n = any nucleotide
  misc_feature (13)..(13): n = any nucleotide
  misc_feature (24)..(24): n = any nucleotide
  misc_feature (176)..(176): n = any nucleotide
  misc_feature (178)..(178): n = any nucleotide
  misc_feature (228)..(228): n = any nucleotide
  misc_feature (286)..(286): n = any nucleotide
  misc_feature (429)..(429): n = any nucleotide
  misc_feature (448)..(448): n = any nucleotide
  misc_feature (455)..(455): n = any nucleotide
tncanctnanncnttaaagatttnttacatactaaaaaactaattaaatgacagtgtaaaagaattggcttcctcatttgtgaaaataacagctacataactatgatcgttcatagctacacatttcttgattatcatcctatcaaaccataaaagcaatacctgtaatataaaantnaaaaactgaacatgtatttcagcacctgtgaatggcacaaatcgtgtgtnacaacacaagtgttactggttaccaccactgatgaacaagaactccagcatttctgantgatgtgaacagattcaagcattcccggtaggtgttcggatactttggactcctctgccctgggcagcacttttgccatcggttgtagtggcactcgaggaagagctcatcaatcaagcaaatagcccctgttttgaaaagcntcggcaccagatcaaactnggtcccntccacatc

SEQ ID NO: 5071 - DNA, 460 bp, Musa acuminata
tttatcctgactttcaagcaccacacagatggttactcccactctaaatctatatgtgatgatccacattgaaccacaaacaagagatgatttcagtgggcaatgacaacaaccctatatctagatttgaagcttttctaaaagctgctaacaatagggcaacatggaaataaaggagcccagagatgacatattacagaaagaccaaaaaaagaaggcttcctattcttatcatcctttcgataagagggaagcatagctatgagcatccaatgatcataactagatcctgagcactgcacacccgaggatgctaccacagcaatgtgtcatgggcgataagggacgccacgtaggcctctcgcttctaacatttaaggcatcaacatcagacagctgcttgatgcactgattcctggggccaggcccgatcactcctccaatcatgtagtctcatctc

SEQ ID NO: 5072 - DNA, 456 bp, Musa acuminata
  misc_feature (8)..(8): n = any nucleotide
  misc_feature (21)..(21): n = any nucleotide
  misc_feature (243)..(243): n = any nucleotide
  misc_feature (319)..(320): n = any nucleotide
  misc_feature (325)..(325): n = any nucleotide
  misc_feature (330)..(330): n = any nucleotide
  misc_feature (353)..(353): n = any nucleotide
  misc_feature (392)..(392): n = any nucleotide
  misc_feature (411)..(411): n = any nucleotide
aacaagcnacacgatttattngagatttggtgttcgagatgaaagcaactccaccagatttgatgccagaaaacacatcaagaaactttttagctcacggtgtggggagtgtgcaaagcctatcgagagcaagtaaacagctgctccaaccagcgcattgtgggaaggttgcaactacttaactttctgtattcttatatacaacatggaaagaaaaaagaagagattcatgtggattattgntcttcacactatatcacttcccttgagaatgttgtacttgcagagcgggcagttggcatggatccgaagccatttnnctatncatgnggaatggaagtgatggttgcatngcagtgcatggagttccaccccatcttcgtatgatgtgnggcaaatacaacactccgnatcctcccgcagaagaacacgctcacttgttgaaattccaccatt

SEQ ID NO: 5073 - DNA, 453 bp, Musa acuminata
  misc_feature (2)..(2): n = any nucleotide
  misc_feature (430)..(430): n = any nucleotide
  misc_feature (432)..(432): n = any nucleotide
tnccttccccttctctgtcaacctcttctgagaaggttatcactctttccttgtttctggtgtacagggttgtattctgggagctctgatgtgaacattaatggggttttggcaagggtgagagggcccttcaccccatctcagtggctggagctggaacaccaggccttgatttacaagtacatcgttgccaaagttgctatcccacccaatctgctcacccctatcaggagaagcctcagttcttctgggttccatcccttatcggctggaccttttggttcaaattcattgggctggggacctttctatctgggatattctggaaatgctgatccagaacccggtaggtgtcgtcggactgacggaaagaaatggcggtgctcgagggatgcagtcgccgaccagaagtactgtgagcgtcacatgnancggggccgccatcgttcaaga

SEQ ID NO: 5074 - DNA, 442 bp, Musa acuminata
  misc_feature (4)..(5): n = any nucleotide
  misc_feature (7)..(7): n = any nucleotide
  misc_feature (9)..(10): n = any nucleotide
  misc_feature (16)..(16): n = any nucleotide
  misc_feature (19)..(19): n = any nucleotide
  misc_feature (36)..(36): n = any nucleotide
  misc_feature (73)..(73): n = any nucleotide
  misc_feature (98)..(98): n = any nucleotide
  misc_feature (136)..(136): n = any nucleotide
  misc_feature (250)..(250): n = any nucleotide
  misc_feature (413)..(413): n = any nucleotide
catnntngnntcgtanacnatcaaacatttgtcacngttcaataataacaatcagtttatatctagcagaacnaaagaactaaaaagaaaaaggaggnagcagcactagaagcaacctacaccttccctctattanacacaaatcattgcctggatctggatttggctctccttgcctcctcaggggatgaaggaaacagctccacgtaccttgacccgatcatcatcttatccttgcgcatagcctttntggcaatctctgccgatgggaactcagcatatgcctccccggttgacctgccgtcggggcggcagacaatgtgcactttctcttcactcagatcaactccccaaagaagtccacgatatctgctgggttgcgcagtatgggagcccccgaagtttcaaggacntcggtgcactccatctggtctttgtcctc

SEQ ID NO: 5075 - DNA, 442 bp, Musa acuminata
  misc_feature (108)..(108): n = any nucleotide
  misc_feature (127)..(127): n = any nucleotide
  misc_feature (208)..(208): n = any nucleotide
  misc_feature (243)..(243): n = any nucleotide
  misc_feature (315)..(315): n = any nucleotide
  misc_feature (409)..(409): n = any nucleotide
ctctgctatggtttttctttcagagatacaaggaagatgatgatagtggctcggaactgctcatcatcaatgtctgaatttggtgatgataactttgagataggcaantgggagttgaaggagcttntgagccgtgatgggcatatgaagcttgccaccgaggtattctttgcatccatcgaccagaggagtgagcgagctgccggcnagagtgcttgcacggccttagtcgctgtccttgcngattggtttcagaagaaccaccatatgatgcccatcaagtcccagtttgacagcctcatccgagaaggctcncttgaatggagaaacctctgtgagaaccaaacattccgggaaattttcccgacaagcattttgacctcgaaacagtcttcaagcaaagattcgncccactctgtgctgttccaaggaagtcattcat

SEQ ID NO: 5076 - DNA, 431 bp, Musa acuminata
  misc_feature (93)..(93): n = any nucleotide
  misc_feature (137)..(137): n = any nucleotide
  misc_feature (291)..(291): n = any nucleotide
tgagaccaaagccatttgctaaacacaacagagtaacaaggttcaatcagccacctacaagtgtctagctcttcatgactagatttttcatanagaataaagttttcaggagttgagagtagaaacaggatggcaanaaaaacaagtgtttatggagctttcgcagtttccctggccgttgcaagcttcgccaaaaggcctgagagctggaggaaggaacccacaccatcacagattctcatatgagcaaatcctgtttccttcaggaattccagcttcaaaaattcagcnatatcatagttcttgataactcggaagagagtggtgattatgtcggtgggggagtaacccagatcgtaaagctgtttcaagccagcacaggcatcatcaaaatttccttcaagcacattgcgaaccatattctttacatg

SEQ ID NO: 5077 - DNA, 421 bp, Musa acuminata
ttgacataatctcagttgaagttctaccgaacgctgcgctgcgcatcgaagaaagcgaacaccagtaagtctaaccagtcatttcatcaaacaccctcgatcgccttcaccctcaccggcaggcctccctccatcctcatggtgaacgtcagcaggtgacgcggctgcctcctctcctccgccacctccacgttaaacctctccaagatgccggccaccagcgccttcatctggatgtaggccatgtccttccccaggcacatccgcggccccgcgtggaacaccgggaacacgaacgggctcttcggccggaacactccctcctcgtccagccacctccacgttaaacctctccaagatgccggccaccagcgccttcatctggatgtaggccatgtccttccccaggcacatccgcggc

SEQ ID NO: 5078 - DNA, 420 bp, Musa acuminata
  misc_feature (72)..(72): n = any nucleotide
  misc_feature (206)..(206): n = any nucleotide
  misc_feature (248)..(248): n = any nucleotide
  misc_feature (371)..(371): n = any nucleotide
tgaaatgacgtctcattggattccatgagcaaatcctgcaaaatttgcgaataaaaataagtaatcaacaanaacaagaagcaaaaactgcatcaactgcttttaatccagctttgcaatgactgcatcaacgacttcttgggtcgtgctgcttcctcccaagtctttagtcctgtacttgccttctgctattacgcgcttcacancggtttcaagccggtctgcaaaggatgggaactgcaggtgcntcaacatcatcgcagatgatagcagcagggccaccgggtttgccttctggtgctccacaatcttctcattccctacgttgcctgctgaagcaccttgctcaaacactgcatgatcttgaccancattacctcctggcatgacaccagtgcctccagcaatacctgcagctgt

SEQ ID NO: 5079 - DNA, 407 bp, Musa acuminata
aatatgctagttgtaattatattacaaacaagggcatagcctcataacacagtccataacatgcagtactcgttatcttcaacaactctatcgactgaaaggaccaggcatgcagatttcgatggttgattataattacccatgtcatccgtagcagcgaatggggtcactacaacctttagctgcagactgcctgaaaccaaagcgtccgcctttctcaagatactgctgatgatactcttctgccctgtagaatttctttgcaggaaggatttctgtcacaatcttcccattaaggaccttctggcgcctctccatggattctctggctgctttttcctgttctggtgtgtagaaatatattccagagcgatattgagtcccaacatcattccctggcgattcag

SEQ ID NO: 5080 - DNA, 401 bp, Musa acuminata
  misc_feature (2)..(2): n = any nucleotide
  misc_feature (7)..(7): n = any nucleotide
  misc_feature (14)..(15): n = any nucleotide
  misc_feature (52)..(53): n = any nucleotide
  misc_feature (78)..(79): n = any nucleotide
  misc_feature (84)..(84): n = any nucleotide
  misc_feature (111)..(111): n = any nucleotide
  misc_feature (124)..(124): n = any nucleotide
  misc_feature (151)..(151): n = any nucleotide
  misc_feature (163)..(163): n = any nucleotide
  misc_feature (210)..(210): n = any nucleotide
  misc_feature (223)..(223): n = any nucleotide
  misc_feature (229)..(229): n = any nucleotide
  misc_feature (231)..(231): n = any nucleotide
  misc_feature (235)..(235): n = any nucleotide
  misc_feature (249)..(249): n = any nucleotide
  misc_feature (253)..(254): n = any nucleotide
  misc_feature (258)..(258): n = any nucleotide
  misc_feature (260)..(260): n = any nucleotide
  misc_feature (267)..(268): n = any nucleotide
  misc_feature (270)..(270): n = any nucleotide
  misc_feature (274)..(274): n = any nucleotide
  misc_feature (280)..(280): n = any nucleotide
  misc_feature (294)..(294): n = any nucleotide
  misc_feature (296)..(297): n = any nucleotide
  misc_feature (300)..(300): n = any nucleotide
  misc_feature (347)..(347): n = any nucleotide
  misc_feature (354)..(355): n = any nucleotide
  misc_feature (370)..(370): n = any nucleotide
  misc_feature (385)..(385): n = any nucleotide
  misc_feature (387)..(387): n = any nucleotide
  misc_feature (390)..(390): n = any nucleotide
cnaccantcaaggnnactggggcaacccctccataaataatgggaacatcannaacttcccagattccacaatcttgnntaagnagcacacgcatgccagcattaacaagngcaatatcatccncccttcggtgtgcttgcttaaactctntgacaaattccnaacttctagtccatggtagggaaactgagagtaaaacttcaccattngcaagatcagctntgaggnanccangaaaaaactctttngcanntacngncctaacnntncctntgcagntcatgatcagcatnanngcncctgccagccatccaaagtggattcaagtctgatattggactagcantgcaggnntttccaccgacagangcaacatccctggancngangtccagcgaac

SEQ ID NO: 5081 - DNA, 399 bp, Musa acuminata
  misc_feature (7)..(7): n = any nucleotide
  misc_feature (18)..(18): n = any nucleotide
  misc_feature (35)..(35): n = any nucleotide
  misc_feature (43)..(43): n = any nucleotide
  misc_feature (50)..(50): n = any nucleotide
  misc_feature (57)..(57): n = any nucleotide
  misc_feature (117)..(117): n = any nucleotide
  misc_feature (140)..(140): n = any nucleotide
  misc_feature (172)..(172): n = any nucleotide
  misc_feature (189)..(189): n = any nucleotide
  misc_feature (238)..(238): n = any nucleotide
  misc_feature (257)..(257): n = any nucleotide
  misc_feature (274)..(274): n = any nucleotide
  misc_feature (306)..(306): n = any nucleotide
  misc_feature (356)..(356): n = any nucleotide
  misc_feature (370)..(370): n = any nucleotide
  misc_feature (387)..(387): n = any nucleotide
ccgtctntgagtggtttnaagttgtccagaaagtnttttagcnatatttntgaaggncgtaaccagttggagaccaaccaatgaagccacttgccgataaaccctaggaggagtgcntgatagggcaattacaaagtccntgcatttctcaaacaaaaccttatcaaacaanggtccattttggcatcnagaaccaagttgtccccgaatgatgcgagattttctttgaagcttttangctccttttgctttgagtnaacatggtcttccactncgccatttttagctagctcccacaagtgagancacaacattcatccacatcagtctcatcaaagggagcggttctagttganaattggctcccacnagcctcaaagagaaacnttagaatctcaa

SEQ ID NO: 5082 - DNA, 396 bp, Musa acuminata
  misc_feature (319)..(319): n = any nucleotide
  misc_feature (390)..(390): n = any nucleotide
aagcacacataatttatttaatggaacttccaaaactttattgaaatcaaactatctcaaacatatttcatcatgagttctcgcatctcctttccaggggcttccaaacctgtgaacagcttaaattgccccattgcttgccttatgaacatctcaaatccaccaacagtggggactccacattcttctgcctccctcagaagcctcgtcactttcggggcgtagaccgcatcgaacaccaaggcgtagtgcccgagagctcgcttagcgagaggagtctcgcccacgtttggctgcatgcccaccgaggtcgcgtttnccaggatcattccgtcctccgggtggaagttctccagctcagagagtggcagtgcctgcccaccaacttgnttcgcc

SEQ ID NO: 5083 - DNA, 383 bp, Musa acuminata
  misc_feature (4)..(4): n = any nucleotide
  misc_feature (7)..(7): n = any nucleotide
  misc_feature (361)..(361): n = any nucleotide
  misc_feature (368)..(368): n = any nucleotide
aganaancatgatatctgctgctgacagaaatgcatgggcgacattctttgcaaggcagggaataaaagttgttttctctaatgggcagcttggaatgggaaccatgaaacttgggagacttgcaaagtcattagctgttagtgtgaataccaaacgtagagcaaaaggactactccctcgtccagtgcgtgctggaatagttggttatcccaatgtaggtaaatcatctctaattaaccggttgctgaagcgaggatgtgtccagctgctcctagacctggagtacaagagaactgaaatgggtacgttttggtaaagatctggagttgttggactctcctggcatattgcccatgaganttagtgnccaggcagctgctat

SEQ ID NO: 5084 - DNA, 1575 bp, Musa acuminata
  misc_feature (342)..(342): n = any nucleotide
  misc_feature (1560)..(1560): n = any nucleotide
acaaacacatcaatcccatgttatgcttggtgctggtcttgttgcaaagaaggcctgtgaattaggtctacaggttaagccttggatcaaaaccagccttgctccaggttctggagttgttaccaagtatttgcttaagagtggcctacaagaatatttgaatcagcaaggatttaatattgttgggtatggctgcacaacatgtatcggaaactctggggatcttgatgagtctgtggctgctgcaatttccgataatgatatagttgctgctgctgttctatctggaaataggaattttgagggacgtgtgcatccattgacacgagctaactatcttgnttcgcctcctcttgttgtagcttatgcgcttgctggaacagttgacattgattttgagaaggagccaattggaacagggaaggatgggaagagcatatacttcaaggatatatggccgtccactgaagagattgcacaggttgtgcaatccagtgttttgcctgaaatgttcaagagtacatatgaggcaatcacaaaaggcaaccctatgtggaaccagctgactgttcctgcaacaactctttattcatgggacccaaattccacctacattcatgaaccaccatattttaaggacatgaccatggctccacctggtccacatggggtgaagaatgcttattgtttattaaattttggcgacagtattacgacagatcacatttcaccagcaggtagcattcacaaggacagtcctgctgcaaagtacctaattgaccgtggtgtagatcgcagagatttcaattcatatggcagccggcggggcaatgatgaaatcatggcaaggggaacatttgcaaatattcgtcttgttaataaactcctcaagggagaagtgggaccaaagactgttcatatcccaacaggggacaaactctatgtctttgaagtagcaatgagatacaaggctgatggggcatgataccataagttttggcaggagcagagtacggaagtggtagctctcgagactgggctgccaaggggccaatgttgttgggagtcaaagctgtgatagctaaaagttttgagaggatccatcgcagcaatttagttgggatgggtatcattccactttgtttcaagcctggtgaggatgctgagacactgggtttgacaggatatgagagctatacgatagatcttccaagttgcatcagcgacataaggcctggtcaagacattactgttgttaccgactctggaaagtcttttacctgtactcttcgatatgatacagaggtagaactggcctacttcaatcatggtggaatccttccattcgtcatcagaaatcttataagttctcaacactagggtgtatgtttctttgtgatgcctcgagctgtcagcattgctggtcttgacctcaattggagtgggcatttcgaataaattagcaggataaggaggcacttctacaagtcatttgcctgtttgctaatgtattttgtgctgataccacagttgcattcaaacttatatatcttttcaganccaatgttattaaac

SEQ ID NO: 5085 - DNA, 960 bp, Musa acuminata
  misc_feature (931)..(931): n = any nucleotide
  misc_feature (940)..(940): n = any nucleotide
  misc_feature (948)..(949): n = any nucleotide
  misc_feature (954)..(954): n = any nucleotide
ttcatcgatttatttagtagaaagaaatgtaacttgtttgatcaaattgatccacaacttataagcaagttgcatccaacacagcagattgaaatgactgttcttttctgaaacacctactacatgaatgtgagtttttgaaccaaattgatgcaactacttctgatgatgagctcctcgtgatgctaatgtacaagttgtggaattcagtaggggttacatcttttagctccatgtttgatccagaagaaggttagctaccatgagatgtgccccttgaggaagcccttgcagagccttttccaagcctcttgatctggttcttgtgcatccaagcttgcctttgctgcttcagcatgacaagtctgaatgagattacgctggagcaaacgatcgacgaggtgcaggagaatgtctttgttgtactccgggtgaccctggatgcccatgatgtgatctccacatctgaacatctcgacgccggtcttctccgagcaagccatcacttccgcatggggcggcagctgccacacctcgtcgcggtggaattcgatgacagggagatgagaggggatgcggagagaagccagcagcttgatggtggagtgaagctgctgaagtggaacacagaagcagtaccaggaaggagctattgcgagctattcaggttgcagagagagcagaaaaacctccgttgagcgagctattcacagatgtgtatgatcaagttcctgcgaacctgcgggagcaagagaaatcactccgcgaaaccatcaagaaacatcggaacgactatccatctgatgtgccggtctagtagaacatccaaaggcccatatctgtagttcattacaactctgttgtttctgggaaccatcaatagatgtattccaagaacaaaggatagaataaatgtaaacaagttgaatanccaaacatncattatanngtttntagtta

SEQ ID NO: 5086 - DNA, 711 bp, Musa acuminata
gaaaaatggattatgtgcggtccatcgtgttgttcaatcgaatgcaaccatataactattctacataacacaaacgcaagggcaaacaaacattcatgaagcagaacaaaaagcaacaaaatctttgagagtaacagtactatttcatgacaattaatcgggcatctagttcaacaataaagaaaaaggaatccgtagctttctcaagaatattgcttaagaggaggctccacttcgaagggcttgacctttcttgggcttgctgggagcaatttgggtctccggctccttcttgactgactcttccttctctgacagaatcaattcaatatggcatggggaggacatgtaagggttgattcgtccatgagcgcgataggttctacgtcttctgctttggagcttggttcacctggatgtgtgatatgtagagagcatcaacatccagccctttcacctcagcattactttctgcattcttaagcagatccaaaatgaaaccagctgatttcgcaggccaacgtccctgcccatttgggtgacggctcttggcttgagctgtacgcccaacacctccacagaaccttcgaaaaggaattgcctgcttgtgagcaattacatcttcaagatatcttttggcctttgataatggtagctttctaagggatgggcggtctcgcgtgtatcttgaagtgaaccctcaagtcctgg

SEQ ID NO: 5087 - DNA, 683 bp, Musa acuminata
  misc_feature (4)..(4): n = any nucleotide
  misc_feature (8)..(8): n = any nucleotide
  misc_feature (20)..(20): n = any nucleotide
  misc_feature (30)..(30): n = any nucleotide
  misc_feature (657)..(657): n = any nucleotide
accnttanaacatcacttancgagctttcnacgaatatattgtctatcttatggcatagaaaacaactaacagtaagttacaaagaacaatccttttaacaattttttttcgtatttaagatgagaatttcaatatgagcttgtcgacatgaatgattatatcatcgatgttcggccgcatcgcaggttggggctgtaacatccagagcacaaactggtggaggttctcaggataaggagggttgtgtccagatggccatttaatctgtgcattcatgacagctaactgtaagcttcctccggattcaccgagtgcatactcaaatggtgatgttccgtacattatcgcatacagggtacaaccgagcgaccagatatctgtcctctcatcaatatcagcatggcttggacagtcccacagctcaggagcacggaagggtgcagaacagtgctcactggcccattcctgtaactgtaaagcctctgatctcgaacgaatttctttccttgcagggcgtgcacttccaaaatccattaaaatagcaagaggaggttgtcccttcctgtgagttatgagaacattaccaggtttcgcatcattatgagctatggaggatcaaactgtgatgtgcttcggaccagcacaaagctgtctgnaaatctgaagaacagttgttgttgta

SEQ ID NO: 5088 - DNA, 439 bp, Musa acuminata
  misc_feature (4)..(4): n = any nucleotide
  misc_feature (18)..(18): n = any nucleotide
catnaaatatattggtantgaaataaagcatatgggatgtgatcttaccggcattaatgcatcagatcccataagaagggagcaattaaagtagaggaatttatagtcatgaggtcgatgatgaaccatcccgtcgaacgcccaccgctgaagtagtagcactgctagtcccaccggcagcaggcagagccgaagaggaagactcccccccagcttccgaattcttctcgggtactgtagcggcggaagcggatgccgaggcagcggtggccgcagacgggtctcgcttacgcttcttcttctcgtaagggatgccccgggccttcgcctggctctcccgcacctccctgaggtaaatcctgacggggcgggcggcgaaggggttggactcggaccggccgccgctctcctcgtaggccgcgcggaggcggccgatgaa

SEQ ID NO: 5089 - DNA, 495 bp, Musa acuminata
  misc_feature (402)..(402): n = any nucleotide
  misc_feature (447)..(447): n = any nucleotide
  misc_feature (457)..(458): n = any nucleotide
  misc_feature (468)..(468): n = any nucleotide
  misc_feature (474)..(474): n = any nucleotide
  misc_feature (481)..(481): n = any nucleotide
acttactaaaataaatgaacaaatgagcacaaagttgacatttttttttgtctttctccctaaaatcaacgaaagcgtggaggagagtactctaatggaggaaagagttcgctaagggggaaggattttgctttaacgagagggtgggcggtggcgccctggtgttgctccgcagctcccgggcagctttctggcggcgcaactccaggatccggcggtgggagttggagtggatggcggcggaaaacgtggggctgctcgccggccggtactccggcacgaggcggaccggacttgtacctgacgccgcacgcgttgcacagcgtcttcggcccctccggccccgcccgccactgcggcgtctcttccgccccgcagtgcccgcagcagcgcctctccacngccgtcgctctcctcgctgcggttatgcaggccggctccgggganaggccggcannacccttccgncgccgnctccgtnccttgctcctcggt

SEQ ID NO: 5090 - DNA, 502 bp, Musa acuminata
  misc_feature (450)..(450): n = any nucleotide
  misc_feature (487)..(488): n = any nucleotide
atacgaaacaattctttcatggcaggcagcgtctcatgaaccccagatgagagcatcgaaacctacaggaggaagtgacatcacaccagacttggaaatctaaatttcatgaagttgaggaggaagaggaggaggcaatgcaggaggaggacacggctcccctcgtcgccagcagctgcgcgatggcctcgtagcccatggacctcgccatgaccagcggcgtggctcccctgttggtcttggcgttgacgttggcgcccatgtcgatgagcgtctccacggtctccaggcacccgccctccaccgccaggtgcagcggcgtgtgcccctccacgtcttggcactccaagtccatgccgaagtcggccagcagcgccaccgcgtcgcgtgtcccttgatcgccgccgcgtggagcgccgtcaggccgtactggtcgcgactgtggacgcngacgcgcttcctcagcaggcactccagccggcgaggnntcctttcctcgatg

SEQ ID NO: 5091 - DNA, 454 bp, Musa acuminata
  misc_feature (5)..(5): n = any nucleotide
  misc_feature (11)..(11): n = any nucleotide
  misc_feature (26)..(26): n = any nucleotide
gagcncattanaaggagaggttgtcnttttacacgaatcacatacgagtcttgtttacaacaccaatataacaacagcagtatcatcaataacaataacaattatttaagactcagaacagaaccaccaagacaacataccaaattcgtcacttttccttcctaaaaatgggtatttcctcggattggagccgagatctgcatgatccccctctttaacctcggcactgggtgatggcggacagctgcgagagtaggggttggcctgggcgccggggcggcagttgtagtaagaggcgccgcgtcgggagccagggcacggtgtcgcgcttgagcgcgccgtagctgatgtagctggaggtagccaggaagcggcggctcacctcggatcccaggtcaaactcctcgcccgcgaggcactccggcgatgctgccgcggcagccggagagggacg

SEQ ID NO: 5092 - DNA, 633 bp, Musa acuminata
  misc_feature (4)..(4): n = any nucleotide
  misc_feature (576)..(576): n = any nucleotide
cagncacgatctaataaatgtaaacaaatcaattacatatttatagcttcttggggagaccaaaacccacgaagaataccactaaacacctctttgatcccttcgcttggggcatttcggcaagaagaagaagaatactacagagacttatcctccaattacgtgggaggcggaggacgcgagaacaccgcaggatggagatcacgcggaggggaatgggctcgctagcttcgctctaagatccttcctcagtatcttgccggatggcgccttgggaatggcctccgtgaagaacaccttgttgatcctcttgtagaataccacctgcttcgagacgtactgcttgatctcctcctccgtgacctgagacccattgcacctcacaacgaaagccacagggacttccccggcgagttcgtccttcatcggaacgacggcagcatcggcaatgtcgtggtgggtgatgagcaaggcctcgagctcagctggggctacctggaaccccttgtacttgatgagctccttgagcctgtccacgataaagatctcgtcgtcgtcgtccaacaagccgatgtnccccgtgtgcagcaagcttccttgtctatggtgttctcgtcgctctggatattgaga

SEQ ID NO: 5093 - DNA, 637 bp, Musa acuminata
  misc_feature (76)..(101): n = any nucleotide
agcttctgtatcactggtagcttacaaccaacctggaggaacacaagctccgctgcctaaaacttcctccccattnnnnnnnnnnnnnnnnnnnnnnnnnnacagatgaacgagctcaccgagctccgataacctgagacgtaaacccccgaggcaccaaaggcatcgtatgcagcaatttgactggcgtgaccggccatgaacgatggacgcactgctgtggcggtgccataatcctccggttgaggcctgctctgtaagtgcgccccgcttcctctggctgcaggaacatcatggttgtgcttgccttcatacgtggtgatcactgaactgggatcttgcgatgccctctccacatgtttccttacggggcagcccatggtagtgcatttgtaataactcctcgggtttggattacccttcaccaccttctgcccatactttctccaacggtacccgtcgtcgaggatatcgacatcgctctgtgtctgcacaaccactctcggctccctcgtaaccctatttccgggagctgataactcttcatggtcaccttctgtcttccatcgttggatctggttcggtttcgtccaaggttcactccccgattgctcctccgagagctcaaatcgatgta

SEQ ID NO: 5094 - DNA, 497 bp, Musa acuminata
taaaatgtttgatcataggttgttcatccctaatctttagggaaacaaatttattgaacacatctacaaaactgaggagaaaatttgaaggtacaacaactccagcaagatcaactcactccagaatagagctaagtctatttaacattggcattaacattgcattcaggcatcatcaagagcaagaacacctggcagaggcttgccctctagcagctccaagctagcaccgccaccagtcgaaatgtggctcatcttgtcggcaagccccactttctctacggcagccactgaatcaccaccaccaatgatggttgtgaccccagatgcactcaactcagccagtttctttgcgattgcctcagttccaagtgcaaacttctcaaattcaaatacccccatgggtccattccatatgatggtcttggtggtatccagggattcactgaatgtcttgatggagtcgggaccaatatcaagacccatccatccatcag

SEQ ID NO: 5095 - DNA, 600 bp, Musa acuminata
  misc_feature (519)..(519): n = any nucleotide
agaactcttgtttccttattgattccttcaagtgttcttctttctacatcagggacttgaactccaaacataagcttgcaatacaattcaaccagagacgaaaatgcagcagtgatttccacagttcgcccaacagatgttgtggctaatgaaagttgtggtgatcaggccatggccagaaggcagattgatctccgatgctgcacagcaagttgctgaagctggccttctggggcgtcattctcgaccttcgggcagtctgggtcagctggcctaactgattggaagtaaggcaagatttggagagggggacaggacctttcggcgaccgatgttcttgagatgtccaagttgatctctgagctgttctcgcttctgttgctgcaagaaccctcggtctctttgttgagattgatgagatctgatgcttctctacctctgagagccaaggcctcagtctggagtttcttgttgtgggcttgcagagcttcattctcggctttaatggcgtcaaactgnctcctgagcacatcgtaatccttctccagttgcttcgcttccacctcgctctcctgttctggaaccagatggccacctgcc

SEQ ID NO: 5096 - DNA, 651 bp, Musa acuminata
tagatctataatgagtggttttctttcgccgattcagatggagatggccggatcacggggaacgatgccatcaagttcttctccttgtcgaatctatctcgccccgatctcaaacagatatgggcgattgcagactctaaacgacaaggctttcttgggtttggagagtttgttacagcaatgcagcttgtggctctagcacaagcagggaatgagattacccaagatacacttgctaatgcagacttggagaaattgaatccaccagtgatggaaggtttagatactctgctctctagaaataaggcgtcaacaaagaaaattgatcctgagatagatgtgaactctaagccacaaaatcctccatcaaccgttcagtggtttagttcaaaatcagcgaagaagatacctctgagccaagttacttcaatcatagatggtttgaagagattatacgttgaaaagctgaagcccttggaagttacttaccggttcaacgattttgtttcaccccttctgacaaacagtgattttgatgctaagcccatggttatgctcttgggtcaatattctactggaaaaacgacattcataaaacatttactcaaaactagctacccaggtgctcatattggatgagaattaggttgt

SEQ ID NO: 5097 - DNA, 588 bp, Musa acuminata
  misc_feature (453)..(453): n = any nucleotide
  misc_feature (536)..(536): n = any nucleotide
gattctcttagtacaaacgaataaatcaataaacatttgtttttatttcggtatcagcagacttccaagccgtagaggactccggcgtgctttccgtcgtcgttgcccatgaagaagagctccttcatccgtcggaacgcttgccaggttagcaaactgtccgaccccgcctggtggcaccgccccaccgcccggtcgacctggagcgtgctcgccacgcgatccaatccgccgtacaggctgtggcagtgcttgatcatgtgcttcatgtcgaacaccctgtccccgaagaagaccctcaccaaacccatgaaatcgcccagattgctgggtaatctgcggcaagttaagatctttatcaagtacccgaagtcgtacgcactgtggaacgtcacccagctcacggccgagtcgttgcacaccagcccggacgacatcaggagctcggcgaanggcgggagtcgatcccccgcgcccggttcttctcgaaatcgatcccgttggacctgaggaggtcgatggactcgggggcgtanggtcgcggtagatgtcgaaatcgcgaaagttgaactccagacgtagcggacc

SEQ ID NO: 5098 - DNA, 566 bp, Musa acuminata
  misc_feature (467)..(467): n = any nucleotide
  misc_feature (480)..(480): n = any nucleotide
  misc_feature (496)..(496): n = any nucleotide
  misc_feature (498)..(498): n = any nucleotide
  misc_feature (501)..(501): n = any nucleotide
  misc_feature (530)..(530): n = any nucleotide
gaagaaacctttttatgcatcaatcaaaaactatcttacaagccacaacaattcatatccgtattggtgtacaataacatatcttgaaacatctcttatggaggaaaaaaaggtagaaaaaggtttgattaccactaacaacaatgtccaagaaaagaacaatgaattgtggttacctcagtacaacatatcagaactgaaagctatgtaattgaagagacgtagaaattgcttggtttaccggcattaagcttcaggtaacacttcaaaatcaaccctgagttgcgagtcatcgtcgtcggagacgatgccacctgccctccttgccttccacttctcgtactcgggatcgtcggtcggcagctcgaaccggcagacggggcaggtgttccggatccccagccacggcaagatgcagtcctcgtggtagaggtgggcagcaaggcagctgcttgactctttccccnaccaagatcccgnctttgcaaaccgcgcncngangttcgccttggcaacatctcctccgtgangagaaccgacggaagctttctatccccgatttggct

SEQ ID NO: 5099 - DNA, 605 bp, Musa acuminata
  misc_feature (520)..(521): n = any nucleotide
  misc_feature (534)..(534): n = any nucleotide
  misc_feature (548)..(548): n = any nucleotide
  misc_feature (552)..(552): n = any nucleotide
  misc_feature (572)..(572): n = any nucleotide
  misc_feature (583)..(583): n = any nucleotide
tttaataatgtgattttgccttttagctttgcagcacacgacacaaatataggtttttctttgtaaagcaatctcacccgttcgattcgtcgatcgattgcatcatcacccaatcatggtaattataggaggtaaaaatacccacaactcccctgctctaatctaacgaggaggaggaggatggcgacggcggcgagttggaggaggaagtggggccccatggggtcatgtccgtggggtagctaccgagaaggcggaggaaggaggtgaactcctggatctcggcgagggcgttctgggcgcgggtctccgccatggacgcctggaagtcgatgtagaacatatactcgaagtgcttggcggtgccgacgttggcgtcgtcgacaaggcggatggggcggtggcggtgggggcggctctcgatcttggtcaggcagatgttgcggaaggcgaaggcggagagcaccttgaagagcacggaggtgccctcgccgtcgtgggcgaagacgatgctggtttnnaaggggcggtcgntgcgggggatgatngctnccgcgccacattcacgaacntcgtcacgttncagccgtcgtctgatcccgtcc

SEQ ID NO: 5100 - DNA, 1078 bp, Musa acuminata
  misc_feature (1075)..(1075): n = any nucleotide
aacattgtttggacaccagtgtataggcacaaaatccttacagatatgctcagaaacaatgtatcaaaacacaaggtgtaggactattttgttcaatatgcatcacaacatggaataaaattggcttatcttcttcaaaggcaagactccgttctgtagaagatgtaacgagatcaaggaattgatacttgaacaggtgcatgcttggcaggatgctctactgctacaaccctttaaaaggtctcaaagatactatcaagccgtgtatcaattatattctgtgttcctgttcagcagcaactttctctttcgtcttcgatcccacatcacttgcagccttggcaactttgttgaatgcaccagttacccaggatgctccggtgaagacatacctgttcttcatgattgcagatcctgcaacacttactttctgctcagctgcagcaaaggctgacttagtcttctcggagacctggaacttctgatccatttccttgaccttttcattgacagctgaagtacccatgctgatcttctcagtcaggccaatttttttgtcgaatgatgaaaccttggcactagctgtggatgtgagttggtgcttctcatcgaaagcttttgctttgccgatagcatctttgcctagaataaagcccttggcgagcataccggtgacaacatcttctgctttctgagaagcagattcagcaccaccagtgactttgacctctttattctaagaaacaaacaagcttcatcacacagtaaaaaaaaagaaagatggaataatggttcaagagaaggcatgtgtcatgcactctaccacagtaggagctgaaacagttacaggtaattggtattctggagcaggtgtaacaataacagagagatcaactattgttgccccctgtacaatgaacaaatgacatctgagagaagaagatttataaccaataacagaaacacaaaccaaggtccctttgttggttctacagaacgcagtacaactttgaaatgaaaaattactcttttttgaaacattttttagataatagatggataattatatttgcanagt

SEQ ID NO: 5101 - DNA, 591 bp, Musa acuminata
  misc_feature (27)..(27): n = any nucleotide
  misc_feature (88)..(88): n = any nucleotide
gtcacttgagagatttttatgaacatnaatgcctgcagaccccagcaagctcatcaagactaatacaaagccaggctttataagatangcaagcagcaggatgaagtacagaagacatggactgaagtccaaatgttccacaagagagtgtcaggtatttgttttacatttacaataatgccccatggtagcatgtaagcattgagttctggtacttttattccataaaaagcacctcgaaaaaggaatatatttcaaaaatatcagtaaaaacttctgcaacttattgaaaactctgaactctcctcctgtgtctgcagatgagtgctaattcttcagtatacccagctgttttagggctgactgaacgtcattggtgccacaaccctcaatctgaagaatattagggctgtcgaatgccacaacatctttcaacagatagcttctggtcgaatggacctggcttggagcagtgttgaatgcacctttcaaaatgacagtcttctgcactccaccaagtaatccttcataatctgtatcaccactttcaccaacaaatactatcatgtttgagagctctatgccccacct

SEQ ID NO: 5102 - DNA, 430 bp, Musa acuminata
  misc_feature (5)..(5): n = any nucleotide
  misc_feature (387)..(387): n = any nucleotide
gatancttacacagagaagtcatagcaagaaaaagaacagaggtctcctgctactactacttgactcagtgcttccttacatgacaacacaacctctggtgttgtcatcactgaaaagatgagttacatactcgttgtatgattgattgctctggagataaggactcggatggcaattgtagtaggcagtgtaaggggatatctgaggggacctgagatacatcatctgcggctgcatgtatctgttgtcatgcaccctaaaattgctcatcatgggggacggatgggcctgatatccctgcatgttcaccatcatggggggctgatgctgccctccgccatgtgaggggaggcctgcgtaccatggaagacgtttccttggaagcntcctcgattgctgtttccaccgagcccacccaggccgagacct

SEQ ID NO: 5103 - DNA, 980 bp, Musa acuminata
  misc_feature (13)..(13): n = any nucleotide
  misc_feature (15)..(15): n = any nucleotide
  misc_feature (856)..(857): n = any nucleotide
  misc_feature (956)..(956): n = any nucleotide
gcacggatgttcncntagatgtttaagactgtagtacaatgagcagtaccctttactgagatttaggaaaatgctgaggtaaagaagtggacacacaatcgaacacttgaaacaaagaagccatctctggcttctgcatttacctctcccatcaaaccatattacaactagaagatggctgacatagcagtttccagcttaaatacatgtcttcttcgcttgtatcatggaggaagctgatgttactcggtggagaaggaagccatggcatgacagaagagagagagcctgatcaggttcttatctgatctggaaatgcttgtacgcaggatttccagggaggtcagcctccctgcagcggtttgatccttctggctgcgtgtcggtagagctcttcctgcgccgctcattgtggccagccaggcgcctgcggcagctcctcttggagtcgtcaaactctgctagctcatggaacctgctgcattgctggcagaacctctggcggaggccggcgaccacgacgacggcagccttggagtgggcctcgcagaccttgtgccggcggtgtaacgtttggcctcgcggaggtcggcggcgcaatcgtcaacctggcagcagggctgcgacactccgccacggcgcctccggcgtcaggccccgtccgtgcagccgctgaggaagagaaacttacccgtcgcttcttgtcatcctccatcacctcctcgtcctcgcccagagtggccacctgagtcggagacagcgcggcctccttcatcgccttctctcgttggctgttccttgacgcgggatcgatcggcgtccttcggcagtccatgagagagagggaggatgaggnngaggaagagtttgtggaattgttgggggagaaggctccggacgagaggggtgcaaaggtgagagagggaaggggcggaaggatggggtccacagcagcngaaccaaccacaatttgtttctgg

SEQ ID NO: 5104 - DNA, 531 bp, Musa acuminata
  misc_feature (499)..(499): n = any nucleotide
tataagatgcaattaattccagtagcacacagcaatcacagtccacaggaagccacttcactgtcgctatgttatgcctcatcattgaaccaaagctcatcaaccacaaacaaccaaccgactttatttaatgaccactcaaacacgacatatcgttctccatctttcacgcacgctactatcactataattattgtccatctcatctgccagggagctacacggcggtgacggcaatcttcatgccggcctggcagtggccggggaagctgcagataaagtagttcgttcctcgggccagcgtgatgcggtcgttcccggaagtgaagaccctcgagcctgtcggagccgagcaacccctgtagccgggccgcgctcaccgcgaccacgttgtgaaccgaaggattgtacctgaaaacgagcacgtcgccgggcctgaagctcttcccactgggccagccgacaacgttgaaggtcagccgccgctgtcgccgacgangtacgtggcggatccgcgatctcgctgtggat

SEQ ID NO: 5105 - DNA, 620 bp, Musa acuminata
  misc_feature (5)..(5): n = any nucleotide
  misc_feature (10)..(10): n = any nucleotide
  misc_feature (22)..(22): n = any nucleotide
gatgncctanaaaattgaggtntcaatagatacagattatccaacagcatttcaacataggctaaagaatggcttggttgtttgaacatccagcacttttaattaggatgaaagaaagcattggaaaacacattcttttgattctgcatccttgataacagaagtgagaattattacactgccaaggatctaaagtctatgagatttgatctcgattatagttgaaaccagatgagatctaggggcattttgctttgtaggcatcccaaccctgggcccggtattctctggcagcttcagcaggatttgtagcctttataattccacggccaactatgatgatatcgctgcctctgtcatggattacagaataaggagtgttgtactgctggcctaatgaatctcccccagaaaccatttgaactcctggtgttgcatgaatgaatgctggatttgctggccccccttgccatgatgctggattgacagatatgaagccaatcacaaaatctgaatgttcttcagctattttcacagcagcagatgtgtaatctcctgtcgcaagatttccagctgagctcatttcagcaagcagcaggaggcccctaccttgacgcagc

SEQ ID NO: 5106 - DNA, 683 bp, Musa acuminata
gtacaaaatataataagagagctgaaaatgacaacagtatgtttacactatgcaagcacaaatctataatgaagaaaaatgtggaacatggataacactatgcaccagtctaagattaatcctgacagtatgtttatacaagtttcataaattaagcacttgacaagttacagggacagagtccctgtctctaggcctttagttttccactcatgccacgcttactgtgccaaacgccactgcgctccccattcagctgattccttcttgctgcaactgaacactgatcagcgcatgcaccattactacacatctcaatctgcgccttgcgccgcctcatccggttctccagcctaacacttctaagggcttgggccctctttgcaacctccaatgcctgtgaaaagttccaaattctaataataccttcctcaccaccacatatgatcctatctgcaccaatgtccacagagaaaagattgcaaccaaagccgtgtagcatcctttgaggtggctccactgcatctggagtggagtgcctgacctgagattgctgacttgaagtgcaagattgaccagacttcaacagcttcctcacattaattagggcgatcctcccatcacttgaagtgacacaacccatggaaactcaaaagcaagtgaatgaacagggctgtgtgtgg

SEQ ID NO: 5107 - DNA, 903 bp, Musa acuminata
  misc_feature (856)..(856): n = any nucleotide
  misc_feature (861)..(861): n = any nucleotide
tactttcaagaactcaaaagtcataatgttgatatggttctaaatgttattcttgtttcatccaagtatggagagtctcgaattcatcaattatgtaccttttaatacatatcacgttatcatatgcggctcacatgttcttgctcttccttatctcggttgatgaaatatccatgcgaaacttttccagtggtatggagatgaacatgtcattcaactcttgaggaatatcaagatcttcaagaaccttgaaaactccatcgaccaagcggccaccaactagaaatgtgcaacctgttcttttgcagccaagaagaatctccagcatttggctataacttccaccataatatttcggattaataagcctcacagcagtgtctgccccaatcacaaaggcacttccagggaaaatttctgctttcttatagaagtatggctggtttgagataatgacagttttccctgcctttctaaattgttctactcgacttttaatttcagccaaagacaatggtggtttgtcaggattgatcactgatatctcgaagcatggaaatccgttctcacagatgcttgatgcaatttctgagagtctcagatgtccatcatgcaatggattaaatgaacctgggcaatatcaccatcctctctgaagctgtgtccttatcaccagaaaaatcataaatcttcatgcaaagcttcccatcaataatttgttgtagctcctcatcctcatcaacttgcctttcatattcatcgggtacttcagattcatacaattctgaactaaaagtggcagaaactttgcaggcatctgaaattgcctttaataagaaatgactggaaaccctgncttcntcttctcgagtcgcaaaccccttcaacaaagtaacacttgat

SEQ ID NO: 5108 - DNA, 488 bp, Musa acuminata
  misc_feature (13)..(13): n = any nucleotide
  misc_feature (445)..(445): n = any nucleotide
aagatcagtcatntatccaagtaaaacaaaatgcatgagggataacagacctaaaccgtaaaagttgaaggcataaaccgccccccaacttattaagcaacatcttaagcagcaaaagattaaagatccccccggaccagcattagtttgaacttaatgcgattgtttaaacactcatcgggtagaataaacaagcctgatcagtacttgtagtccttgacatggaggctctcggagacaccttctcctccggcagcatcacccttgtacgtcccgagtgttgcctcggagttcgccttgcaccttgtgaggagagcggccctcgccttctggacgttctcctccttgccagcccacgccttgagcgtgctctgctgcagagcgcggccgaacgaaaaggacagcgaccatggtttcttccccttcagcttgttcattgcgttcnggttcagagtagctcctcttcgctctgccctcctgagaggaag

SEQ ID NO: 5109 - DNA, 541 bp, Musa acuminata
tatgatgtgtgtcaaaacttaaaataaagttgacaattaaggttcatgatgattcaactagttgagagatgatctaactgtggatgcttcagaatccagcttctcaaggatgatttcgtccgaagagcaaatcttctactcatggactctctcctcggtatccagaaatttagatatgacacacaaatcaccagacagatgcgacaaacatgatcatgtcttcaatggagccttcttctctctatcggatatgcgagaaggaccagttgtatgtgatttaaaccgacctctccccccttcctccttttccttcttcttcactatctggacaacgtcctcgtcatggagattgtgtgacagaccacaatgttgtgggtagtgccgtgcactagttccccaaacaagaacatattttaaatctttaattatgctacgatgtatatgattacagaagtcttccacagtgcatccacctctatcagtagaaaggacaaaaggatctgtaaaatcaggctgttgtcctgaggctttgaataaactc

SEQ ID NO: 5110 - DNA, 647 bp, Musa acuminata
  misc_feature (4)..(4): n = any nucleotide
  misc_feature (344)..(344): n = any nucleotide
  misc_feature (525)..(525): n = any nucleotide
  misc_feature (556)..(556): n = any nucleotide
  misc_feature (562)..(563): n = any nucleotide
  misc_feature (623)..(623): n = any nucleotide
tatntgtagtattttattatcattattcgacaacaggcgcatggccaagtcacagttccaacacacatcaataatctcacttttttttatgtttgcttgtttttggaataaaaaataaaaaagaagcgggggggttgtaaagagagaggaaaggagtgcttcaaaagtcgggacggctcggatggacggattccaggttcaaccggagaagccggtctggctccaaactgcgtcgcgaacccggctcatgtcgcggcctttgagcgtcctccccgcgccttccagcaccgacgtcgccaggcacctcccgtgcgccctggccaagtactcgtgcggcggcagcnactccccatccgcgtcttcctcctcccgctccggtgacggccctccagagcgggtccggagcgcccacggccaggccggcacgtccacgggagccgaagccgccgccgccaacaatgcggtgccgctcgtatggcggatggggggccggcgcccctgggtacgcgtcctccaatgccaggnagatcccgccgacgtgccgatcggcccagcngcgggnnccggtgagcccgtcccgggcggcccatatcgtggtggtcgccgtcgccaacggcgcgaanaaggccgggtgatcgtcggcggcg

SEQ ID NO: 5111 - DNA, 618 bp, Musa acuminata
  misc_feature (13)..(13): n = any nucleotide
ccgtgggcgtcancgagcaggttgtcatggaaaagcatgtgatcgatggacggatggttgaggcgaagaaagctgttcccaaggacgaccaacagatcctctatagaaacaacagcaacgtgcatgcttctcctggtaacggccgcactaagaagatttttgtgggaggcctgccatccaccattacagagggtgacttcaagaagtactttgatcagtttgggacagtcactgatgttgtggtgatgtatgatcacaacacccgtaggcccaggggatttggtttcatcacctacgactcagaggatgctgtggataaggtgctatttaaaagcttccatgagctgaatggcaagatggtagaggtcaagagagctgttcccagagaactctccccagggcctaacatgcgctcccctattggcggatataactccggtctgaatagagtgaacagctttctgaatggatatactcagggatacaatccaagcttgattggtggctacggaatgaggacggatagtcgattaggactttctagtagtgcaaggaatggtttctcttcatttgggtcctggctttggaatgaagatgaattttgaacctagtatgata

SEQ ID NO: 5112 - DNA, 648 bp, Musa acuminata
  misc_feature (14)..(14): n = any nucleotide
  misc_feature (44)..(44): n = any nucleotide
  misc_feature (344)..(344): n = any nucleotide
tgtatatatttttnttgttattttccattaaacaatcaatcacncaatacttccaattgttgacgaagaagaaagaaacatacacatacagttttaaaatgaaagaatatttcgggtatttatatttatttggccttgggactgcacgccgggttggaggcgaggctggtgagccacacctggtccgccacaaccgcctcgtcgtcgtcgttccggtgccacgtccacagcgcatgcatcccgttcgccatctctagccgcccgtgcccgaagctggcctccctgaactccgagaacgccggctgcggcttctgaaaactcttcgccagcccttccctgttgcngccgtcgcctatggtgatgtgcaccggcccgcaggcatccgccttgccgtcgtgcacgcgcgtgaaccgctcgtacgcgtgcacgtgccccgcgaacaccgcgtcgacgcgggcgccgtacagcagcgcctccatggccttccgcatctcctccccctctccctggtgcgcctcgttggagttgtaccacggggcgtggatcagcgccaccaaccacggcgtcctcgcaacggtcgacccggggcgaggtcggcgggcaagccactttgtactggggcggaatcgggggccgaagtcggtgtac

SEQ ID NO: 5113 - DNA, 569 bp, Musa acuminata
agcagaatgcagacatctcatatattatcagaatatgcaatcttcgtgaactaaaacagcaatcaggagtactgtgcttgaagaagaatgacaataacgtacttgggaacataaagactaccacacgagatgaaaagtcctttgaagtaaaatgtccaacaaacctctccagtggtggttctcgagtttaaacataagctttccttggagctacttccgcacaaatatttctgtcacctaaaatggctacaaacaatttgctgaaatttctcctcaacgagaaccagttggcccagggcagaaaaagtgtaccaggatcatggcttgaaaggtgcaaataccaccacagagttgtgccctccaaatccgaatgaatttgagatagcaatattaacttcatgctgctgctttttgttagcaactgtgtcaaactcaactgctggctcgggattaaattgatttatactaggatgcaaccatccagtagtgtggctttcactgttgcgatggcctctaaacctcctgctgctccaaggcgtgccctatcatagacttggttgcattcatct

SEQ ID NO: 5114 - DNA, 602 bp, Musa acuminata
atatattggtcattaagaacttgataaataaggttaatgtgcttaaacaacactagcggaagtaacacttaaaggaggaaattgcaactcatatttttgcagcaaagaagagatcctcatcggacacaattagctgatgaagaaaagctgcatgctctgtctcgaagcaatcccaccgttcatcaaggatcgatctcgatcatgatgagagaccgagggagtaggggaacccagttcgcctccagccagctcgaccccgcgatgaagctcccgggcgtgaactccgccgcctcggctgcacttgtgatcaccttgtaccccttccactgcacccggctgccggtcccggcgccagcccccgtgttccggtactcgccgtagtacaaggtgtcgagcgcgaacgtcccgctccactcgtgccacccttccggctccgatcacgtcgctgatctccgactccattatcaccgtcctcgcgtactccttccacggccggccgaggtaggtccggaacgacccctgcacgggcgcaaggttgggcgccgcgtgatgcgggaccggtggatgatatcccggtgggctcgttggggtcgtcgcgcccc

SEQ ID NO: 5115 - DNA, 591 bp, Musa acuminata
  misc_feature (4)..(4): n = any nucleotide
  misc_feature (6)..(6): n = any nucleotide
  misc_feature (20)..(20): n = any nucleotide
  misc_feature (521)..(521): n = any nucleotide
gttncntatatattatatanttctttattatcaataaatcagaagaggacatcacatatcaaatgtttcagtgggattgtaacaaaggcaatccctcaatcatctttcgtggggtaagaagccatcatgttgataccacagaggccttcgggcttccccgtgttcctcttcatccttatgtaacccctctccccccacctcgggccccacgagttcttcacgatgatgtaatcctgtccctcggatgagccatatcccaccgctgccaccccatgatccagttcacttccgcacggcccatcgaacactcccccactgtagaactggaagctcctgccggaagcttcaatggcgacgcttacaggttggtttgccagcgccttcaacaggctctcctcgctgttctccggcacatcctcgtagccactgatggtgaccatctcgagatcagcctctgctcctcgcaggtgcttcttccatgagataggggtagcatctcggtgtgcagcccaacagtggangcatgaacgagaaggataatcatcagccctccattgcagccgttgttttgggtgtcgaatcgatcaatgc

SEQ ID NO: 5116 - DNA, 557 bp, Musa acuminata
  misc_feature (142)..(163): n = any nucleotide
acgcggatgatatattacgggaatattctatttcgattgattgaagggagattttgagtccaagcagatcggatcgtcctaaccaatccacctgctacttcgactgctagagttcggagcgggaggaggaggggagcgtcannnnnnnnnnnnnnnnnnnnnnacggagatggttaaggaaaccgattactatgacgtgttaggtgtcagcccgtcggccacagaggccgagatcaagaaggcctattacacaaaggcaagacaggtgcatcctgataagaacccaaatgatccccgtgcagcccaaaattttcaggttttgggtgaggcataccaagtgctaagtgatccaacacaacgtgaagcttatgatgctaatggaaaatctggcatttccagggaagcaattattgaccctgcagcgatctttgcaatgctttttgggagtgaattatttgaggattatattggccaactagccatggcatcaatggcttcacttgataatttcactgaagggggaacaagtcgatgccagaaagttaccagaaaaaatg

SEQ ID NO: 5117 - DNA, 405 bp, Musa acuminata
cccgtttcttaatcgtaaatatttctgcaaaggccgggcaaataaaatccacatacagaacaaatttttctactttaaccagtccgttgattggctgccttcattctatctctagtaactttcatgaacctgtttccaatttcagtctgtggtcatcggttcggacatgcaacatctaaatcgagcctttcggacagtgcttacgatctccatctctgcagtctccagcatttctaacaacctctgtgaagggaggacgcacatcagggtttgcgtcccagcagcgggtcattatctcgccaagcaccggaaggcaatcatgcggtatgatcggtcggacacccttgttaacgacagcaaatgctgcctgcacagctgtcatgttctggaagggaagcataccag

SEQ ID NO: 5118 - DNA, 479 bp, Musa acuminata
tatacttatagacaaagcaaagacacaaacatagaatccaattgaaggttggtggacacagtaaaaccactcgttccttcacagagaagatgacagccttcaaccatggaagtagagaagaggtcgaacagcgcgatcttctaaaaccggatggaggacgcgtaggtgtcgccgaacttccaagtcgccggcgcgacatcgtaggcggtcttgaccttgccgtcgctggtctgcacccggaaggagaggctctgaccagtgaggtacgcgttgctctgccagttcatgccccagttcctgctcatggccatccactgcgtgtcggaccccttgatccagggcgccggagaccacgccgctccctcccacgttggcgatcagcaccagtcgaagtagttcttcccgttgatggtgaacctgatgcctccgctcctctgacacttgaccctgcggtagtagacgggaacgatgccgccccg

SEQ ID NO: 5119 - DNA, 586 bp, Musa acuminata
ttttaactttcttgcagcttacaataacaacatagtaaaaaaataataatgtggaatatgaggaaacctaagactgcaaatacacccaagaaaggcatgaccgtgtaagaaatctcagatgacttccaactttaaatttgtacaatactgctggtttcataatttgatagtctaaaaagttccgtagatccaagtcttccaagccgattggttctctcgcaaatcaaccaagctactgcagaagcgaacaatgatgcagccccacgtagccatttagcaaccaacaaaactgcaacaggatcaacctagcaagcagtagctgagaaacatttgaatgcaagagcttcaatagctaaagagattccattatcgcggagagctggcttcatgtctgtaccggagagccaaaattttgaaatgttctaatttcaccaccccagcctgcagtcacaatcgccaatccccaggctgacatactttgggctgtcgtgcctgcactgcaaaaatcaccattgcattgagggctctgtttattagctgtcatgagctcttcaggcaagttgcagaagccctatcgctaaccgtt

SEQ ID NO: 5120 - DNA, 593 bp, Musa acuminata
  misc_feature (293)..(293): n = any nucleotide
  misc_feature (297)..(297): n = any nucleotide
  misc_feature (323)..(323): n = any nucleotide
  misc_feature (330)..(330): n = any nucleotide
  misc_feature (335)..(335): n = any nucleotide
  misc_feature (339)..(339): n = any nucleotide
  misc_feature (352)..(352): n = any nucleotide
  misc_feature (356)..(356): n = any nucleotide
  misc_feature (376)..(376): n = any nucleotide
  misc_feature (396)..(396): n = any nucleotide
  misc_feature (433)..(433): n = any nucleotide
  misc_feature (535)..(535): n = any nucleotide
  misc_feature (573)..(578): n = any nucleotide
  misc_feature (582)..(582): n = any nucleotide
caatgcaatgacaacattgaactatagaattctctgtgacagaatcttcctcaactaggttagtcttagaacacttaagaagcaaaagaagtaaccttacctgccaattgctccccgagccctaatgcagcagcgagtttagccatgtctttcctggaagcatgctccagaacgagcttcttcaggaagccttcttcgaatcgtgatctcagaccaaacgccaccaccatctgcagaaatatttgcgcctctgaaccacccatggttcatccttctcatcctcctttctcctnctancatggcttccttctataatggccttntcgcggntggcnatcntctctctgctagngagncgcccgcccaggctaagctntcgccggcccatctacgccntgacgtgccccgacctggagagcagtcgtgcggtcgntcatggcgcaggtcgtcggccaggatccccggatgggcgcctccgtcattcgcatcttcttccatgactgcttcgtcaacggctgcgacgcgtccgtcctcntggatgacacaccgacgatgaggggcgagaagaacgcnnnnnngggnatggggccaaa

SEQ ID NO: 5121 - DNA, 1011 bp, Musa acuminata
  misc_feature (23)..(23): n = any nucleotide
  misc_feature (954)..(954): n = any nucleotide
  misc_feature (1006)..(1006): n = any nucleotide
tacacacatcatgcatttgatanttaagcaaaactacaatatatggagtacgtacacgtactggtaaaatgataacaccttatttggcacccacagattgtccttattatgactggggataaaggctttagcattaagcctccaccaactaaataatcgaagtggatacacacgagtacatggctgtcacaacgaagaagaacacgagatcatggctgcaactcaagcgcacaggtagccataggggaccttcttgccgcagtagttgaggaggagggtgagatcgacgtcgacgttgaggctgatgcccaagatgttggccttgatggcggtgcagaggcacaaggcggcttcgaagtcggcgaggccctcgatgaggctgcagcagggtttcttgggcggggtgacgatctggaggttgatgaggccgccgagcacgttggcgcaggcgcccagcttgaccgtgtcgatgggacaggaaggcatgccgggtttgggagtaggtttgggtctgggcgaaggcgggttacatcatggaggcggggacggcgatgtggaagaaggtggaggtgccagaagaatattccggcaacatccatgccggttgctgcctcgagatctaattacatgcacaagtcttcggtgccaccgtctccgctaccattcattccctgccaccagttttgttctcccttatctgaggacctgtacagctttttggtgcacagtggcgagtctatcttcgacatggaagtctccggcgctataagaaaagatgtggatgggggacgacgatgcaatccacatcctaaatggaggagacaacttgggatatctaagtattatccttgcaataatatatgatcccctgataaccttctcatcatcatgtcacttcaatcttttaatcgccggatgacttaactaaccatactcgttgtcatgagtgtgacnccttccctcatattttgactcagacatttaatggtattaagttaactaatantattt

SEQ ID NO: 5122 - DNA, 754 bp, Musa acuminata
  misc_feature (25)..(25): n = any nucleotide
  misc_feature (155)..(155): n = any nucleotide
  misc_feature (189)..(189): n = any nucleotide
  misc_feature (191)..(191): n = any nucleotide
  misc_feature (193)..(193): n = any nucleotide
  misc_feature (210)..(210): n = any nucleotide
  misc_feature (217)..(217): n = any nucleotide
  misc_feature (225)..(225): n = any nucleotide
  misc_feature (232)..(232): n = any nucleotide
  misc_feature (265)..(265): n = any nucleotide
  misc_feature (298)..(298): n = any nucleotide
  misc_feature (321)..(321): n = any nucleotide
  misc_feature (344)..(344): n = any nucleotide
  misc_feature (367)..(367): n = any nucleotide
  misc_feature (379)..(379): n = any nucleotide
  misc_feature (403)..(403): n = any nucleotide
  misc_feature (710)..(710): n = any nucleotide
gttgttgtcgtaccgggcggaggantccccttacagcactcatttggacgaatcttagaatggggagcttctggctgttgagggtggtgatccttccagcgcgcggattgaagtagtcagcacgcaagtggtgatccatccagagttcaactcangcaaaccatcagtttgagctcaacattttgttangncnaagtcttggcactgggntacatancttggagntaggctngagaagcagggcacctgctcaaacccctctgantagaaaggggtttggccaaaggtgatgcagttntccattagagctgagagggactntgaacccgagttttcatggcttncctccatgcttggcatggtgganatccttctgttnttgcagaagactctacatagggcncagtcttgaaaggcaactttggagcaccatcagatccttccatgcggaattcatgcatgacccactttgtcttcttccccttgggagctcttccttgatagaacgccaaagtcttcctcatcccaaccagcaatccttttcgggtcactggtttatccttccctgtggccttccagtagcctgacatggtcgcccggttggtccgctgcccggtcgcgtacttcagatctcgaaggctgaagaggtaccactcgttgctcccaacacatgcggcagcagggagatcccatggctcacacttgttganatcaacatccaccatcatcatggaaccgctctcggtgctgcctc

SEQ ID NO: 5123 - DNA, 463 bp, Musa acuminata
  misc_feature (5)..(5): n = any nucleotide
  misc_feature (19)..(19): n = any nucleotide
  misc_feature (22)..(22): n = any nucleotide
  misc_feature (41)..(41): n = any nucleotide
tccgnaataccaccaactngtntcatacaaacatcaaatcncagagagtggctttatgtagctacaaattcaaatcccaacacctctcacataagactacactgagaacagacatcttatggtgcatggacaaaagctggttatcattcatccaccaaaaaaaaacgaaaaaaaaacactatcaaaaggctaaagacatggcttctgcttatcaggtcctcaaaaaatagtatgctttctttctatctgctcactatgagaccgaatgccttgtgttccttgaatgagtagacttggcttcctcttgattgcctggagtcggggctctcggacatgtccgagctgctgttttcgctgccttgccctttgcttgaccacagcttgttcagtatcttcttcgacatcggaattcccttgactttgtcattggccttatcatcaccatggctattggacatcacca

SEQ ID NO: 5124 - DNA, 571 bp, Musa acuminata
  misc_feature (7)..(7): n = any nucleotide
  misc_feature (9)..(9): n = any nucleotide
  misc_feature (36)..(36): n = any nucleotide
  misc_feature (105)..(105): n = any nucleotide
  misc_feature (232)..(232): n = any nucleotide
  misc_feature (311)..(311): n = any nucleotide
  misc_feature (315)..(315): n = any nucleotide
  misc_feature (350)..(350): n = any nucleotide
  misc_feature (358)..(358): n = any nucleotide
  misc_feature (381)..(381): n = any nucleotide
  misc_feature (436)..(436): n = any nucleotide
  misc_feature (527)..(527): n = any nucleotide
  misc_feature (546)..(546): n = any nucleotide
  misc_feature (548)..(548): n = any nucleotide
  misc_feature (558)..(558): n = any nucleotide
aataccngnttcgaacaatgaggtacatccataatnaagatagattactgtttacatatctagaattctttcattagtgggatctgaaaagattcgagagaaacnaaggcattaaaatcttacaagtttcggcatactatcatccatcaaagaaagatgccttccactactttgattgccaaaccatgaactaatctccacaagactggttacagctcactataattgcgcnatactgcacggaactccttcgcggaatgtgttaagacgtgcttttaaattaggtgttcggaagcttgcatgaagcagtnttgnaagcagtccatgaccagtgcccaaagaattgtgangaggttgnaggaggtcaaccagaggatgcanctagctgctgagaatattaagacaaacacccagcgacgacatccacatatatganttgccctttttgcagatgaccgtgcacgaagaacaggcgtcataggtggctcaactttgcagccagatgtggagagaactgcctaacagtncttgtcactttctcagtgnancaaactgcanagctatcatttag

SEQ ID NO: 5125 - DNA, 596 bp, Musa acuminata
ctgcttcatcaaagtgctgagagtcacagctttgtgtttttattagaaataacgtcggagtccgatgcgatgatagttcacatccagaaagtaacaattattgaacatgcagatttcttaactagcttgtagcatgggaaaaaagctctgcaagttctaaagaaaggagaccctactggctgaggaatgacttactcccagctgcaattttagcagatgagttttcaacacctgtgctagcaacacatgttacagtggagatttgagtacgacgattctctccgatgcgcactacaggtttccttgtacgatgagacaccaattgctactgcattttgcataaacttgatggcaccttcacatgatgcggcatgatctttatatcatacggcacatgaagccattcgtcgagagaatgcgataggaaattctcaggcttacttgtatatacatctgcatattgatggatgtggtaggaaatgctgactcatgaccagtgtcagtgaggaatgttgcaccgaagaaactattgaacatactccgcattgtagatcgacaatgtgcctttccacattaagttcatctgccagtttgcg

SEQ ID NO: 5126 - DNA, 601 bp, Musa acuminata
taattcagttctttactcatatatgacactggggaacttctgctctgtaccacagtttttaaaaactccaactatcaattgtttcataacttgatgctctcttttctattcaggtgctctttgtgatgtatcattactttgcggccaaagaaatttataatgcaattcgtgtcttcattgctggttatgtgtggatgactggatttggtaacttctcttattactatgtccgtaaagatttcagcttcgcacggttttgtcaggtgatgatcacacacaagtcattcttcttttcttggcaattttactagcaattatgaaatggaagctgataacttctgtcatgttgaacagatgatgtggcggctgaatttttttgtggcattttgttgtattctcctcgataaccattatatgctgtattacatctgcccgatgcacagcatttttcaccctgatggtctactgttcgcttggaatttttaacaaacacaacaataagggatcagttattgctgtcaaaattgctgcctgttttgtggtgattgctgtgatatgggaggtaccacatgtctatgatatgtttggagccctttgcttt

SEQ ID NO: 5127 - DNA, 849 bp, Musa acuminata
  misc_feature (811)..(811): n = any nucleotide
  misc_feature (816)..(816): n = any nucleotide
  misc_feature (845)..(845): n = any nucleotide
atgaatttatcatttattacagtctataattagcatggaacattcctttgacaatcccactgcagaaacaccgaaaatttgaaccagaaatagctccaacatctatgatgcaacatgaaataagaacaacttcaggtatcgagacaccatggaacgaactatagttacaaatacaaacagtttaatcatgatatttttatggcgaactaaacaacatcgaggaacttaatgataatctaatgacgatataatgacgatacgatggttatgtgtgcagaactcttcaagtaggcatccggaaattatggaccggtgcggtaaaggccatcaaccatgaactgtccttccatgtataaggcggcagcattctgcggatggaagctatccatcacgacgaactgcatgtcctccgatggtttccaatgccgtttcctttggtttatgaaccaattattgatttgcttcggatcgaggcctgttgatttggccagggccaccttttctgtttccgatggatatggccacttgcagtgcagctcccaccagttgagtagtttttgccgggcttcctttggcagttttcctttcttcttcttcttggatagctcctgcctgagactgcccaagtacccaccgtacttctttagaaggtggtgcttcagctctttatcctcaccatgcgaatcgatcaagggaagatcgatgtctccaccaccgctagcgtctggatcttcttcagaggatgtgacaccttcgcatctctcatccgcagttcgaaggagaagagccgcggcgatgaagtgttggtganccgtngaactgtgattcgactctctttaggagtntgtg

SEQ ID NO: 5128 - DNA, 570 bp, Musa acuminata
  misc_feature (488)..(488): n = any nucleotide
  misc_feature (524)..(524): n = any nucleotide
  misc_feature (538)..(538): n = any nucleotide
  misc_feature (547)..(547): n = any nucleotide
  misc_feature (565)..(565): n = any nucleotide
gtgctttgttatcgtattaataaaaggtttagaaaagtcttatggtacatggatttttgtaaccaagcaccatgctgatttctcttatactttgttcccctacaatctgctcttcaaagatgatgtgttgttatgtcaactaagcagccagaaacttcatacaaataggaggattaacctttgctaaggctagcaatgatgaaggtagaatccatagtccatctccacagatcagaccagaggcgacagccggtcaccatcaaggccgccttcttcctattgagcttgtgccaggcaaacactaccaagctcccaacacacatgtcgattgcgaactggctccgactaggaaaggcactgccattgccatcggcagaggaacccaatgactgtacttagctggcaaaatatctctcatcgtgttcataaccactgcgaatccgaagaagccataacagagctgcaagcaatggtgaggaagtgtgagnaaccctcaacaccaagaattgccatgtttctgtatntcaaagcataaggngcttccaanttccatctggattcccantatcg

SEQ ID NO: 5129 - DNA, 512 bp, Musa acuminata
aatttctgataacacatgaaaacacataatggtgatcacagaatttcactgaacaacctcttgtgcgacaattgtaatactaataaggaagttcagcatattgagattgtttattatggtaaccaagtaaggatcaacatttgttggcatagcaatgaagaatttcatcatgaacactgtgatgccgatatgggcataatcctccaacatcatatgtacctggataacgttgaatttccagttacattgagcagttgcacccattgtcccagcagcatttccatggtatgcattcctgagtgatatgatatcatggcaaccagtataaagccgagcaatcattaatgccagctcatttgcttcagtaccagagtttgtgaaaaacacaaccttaagatccccaggcaactttgaagctaatgcctcagcaaaatccgcaatcgcatggtttagatataaaacagtagaatgttgcagccgttcatctgattaattatggcttcataacttca

SEQ ID NO: 5130 - DNA, 550 bp, Musa acuminata
  misc_feature (6)..(6): n = any nucleotide
  misc_feature (61)..(82): n = any nucleotide
  misc_feature (138)..(138): n = any nucleotide
ttaaanttttaatttcaagagacaataaagaaaagaagtacatatttaagagcttcttatnnnnnnnnnnnnnnnnnnnnnntgggtgtggctgtaccagtaacagctcaaagtataatacttatacgtatgactcanccgacgaggtcttcctccttgtgggtctcgatgacgacgtcggacgtggggtaggcgacgcaggtgagcacgaagccggcgccgatctggtcgtcgtcgaggaagctgccgtcggactggtccaccgaaccctgcaccaccttgccggcgcaggaggagcaggagccggcgtggcacgagtaggatagatcgatctccgcctcctccgctgcgtccaggatgtacacgtcgtcggggcattctatcaccttctctccctctggcgtcacaacttgaccttgtagacgggccatggcggtcacccggccccgcccggcgtccaccccgaagagggagcggcccagcttgggcagggcgcgcaggctcacgccgggcgctctgccgcagcgcgaaggggcgtgccgagggagag

SEQ ID NO: 5131 - DNA, 592 bp, Musa acuminata
accttctcaagtggaccgcacagaacagcagtttgcacacactacacacttgcagagaacagaaggtacctttgatggaaccaccaaatcttctctcaggactgtagcaatgaggaagaagaggagaaggtcccaaacaacagttcttgagccaccagcagccatgtctatagaccacaatataattgttctatggaaatttagactctctattatacatatcttacaactgatctgtgtctaagccatctccctgcagatcatcaagctttgggaaagagctggatgtgataaccatttgggaatcctaatcctggcgttcggactatatttcctcctctgattgccctccagctgtatttggtcaccaagcaatggaggaagatggccatctgcagcttggcgaattcagcgcccacacagaatctcatgccccctccaaaagccatgaaatgcttggacccaccattcagttctggcctctccttccatctacttgggtcgaaggtgagtggatcctcgtatatctcagggttcagatgcactgctggaggacacaccatgattcggccatcctgcaggaattgtgtat

SEQ ID NO: 5132 - DNA, 598 bp, Musa acuminata
  misc_feature (11)..(11): n = any nucleotide
  misc_feature (16)..(16): n = any nucleotide
aacacattaantgacnagaaatcctgaattattccaatcaaaacatagcaagagagaaaactcggttgttattagagcttgaacataatactgcaaggaagagaaactcaattgttcttagggcacaggacacggcttcgatattctccaagagcccagattggaaatatatttcgatatgctgaataactgatcatgcagtttctgttgaagacccccataatctcttgttggggaaactcgccattctccatctgcatatttattaaaacttttgctgctcgatgcaatggtttggatctctctcacactgcccagcatcaattagagttagcatagcccaaccagtattcactgcatgagttctgttgccctcaatattggtgtagaccttatcttgacatgaaaggtagctctctccccagccaccagaagccagttgtttagacaacaggaagttacatgcttttcggatgcaagagctgctctcatatgtccttccagcagcaactaatcccttcactccaaaccatatgccataggtgaagcaacaccccaagatccataccatgaaccatcagcttgctgaatctttcaa

SEQ ID NO: 5133 - DNA, 583 bp, Musa acuminata
  misc_feature (528)..(528): n = any nucleotide
ctttcttaaatatgcttggcaaacaaaattgccaaatagcatctacaaaaagctcaagttactctcatggtgctcacacacccaaactatgataaagcttgtgatacacaggccacataaataaacatggtggaagacaagaccacagggatcagaatcagatttaaaggtgaatatttttgtctgacatctcaaatggactctttgaaaagacgaggaagcacttcgtgtgcactgatatccaatgcctctgggttcctgcacaaaatccggcctttctccgtggagctaggaatgaaccataatttacgcaataaaggtgactcaaattgcacaaagaagccattactctggccaagcttccactttcttgaaccttgccctttccacacctgtggataggccataatgctctttggtgcaaccaagcaagcagccctggaaaatgagtcctctgcatactgccttaaaaataagaaacagttgctgtgtgtatggggagattcaaatgccttgtctatattgacnactggagcatacttatcagtctgagtcttctgcttatcaagaaggaaattaaccc

SEQ ID NO: 5134 - DNA, 666 bp, Musa acuminata
  misc_feature (7)..(7): n = any nucleotide
  misc_feature (12)..(12): n = any nucleotide
  misc_feature (17)..(17): n = any nucleotide
  misc_feature (628)..(628): n = any nucleotide
  misc_feature (637)..(637): n = any nucleotide
tcatggnatttnatcanaacttaagaatcatacatgagaaatccatcaatgggggattacaactatgagctctgttctttaatggcttctgcataacctttgtaaaaataacacatttttatctcgattcctacactcagtatgataagacttcgcgagtgattgaatccttcctctatgcttgccaagaccaccctcatcattaatctaagcaatgaaggttgctaatgacttctatcagaagcttacatcttcatgaaatctaatatgtataatcgagtggaacagttgatcaaacagccatggccgatggtgaccgataaccattcggatgtgatttctgccatctccatgcggttgagaggctcttttgaagatcggtgtaatgtgcggtccagttgagctccgaattgatttttgaagggtcactgtagacttcggcatagtcccctggtctacgttcaaggtagtcaactttgatgttcaccccagttgccttcttgcaggcctcgacaaattctttgactgaccttccttttccagtaccaacgttgtatatgccaactttgttaggccttgcttgtcaagagtttcacatgagcatcaacaaggtcagtgacatcgatanagtctctgntacaagttcatcacttgttgcgtagtctg

SEQ ID NO: 5135 - DNA, 568 bp, Musa acuminata
  misc_feature (4)..(4): n = any nucleotide
  misc_feature (519)..(519): n = any nucleotide
gccngctaagttattacacccttcacccactcgcacaagtcttatgacaagaatatcccgaaaaagaacaaattgtctgtctacatttgtgtaatctacaatccaaatgggagcgctatgggaaacaacagacagatagattgagttgagcattttacaacctctattgcacaacctggggaagacttggtagcaatgaaataggagagacagtgcttgaattttttttctgtactacctgcacaaagacacataagaaggccaaaagatcagcccttacaaagagtagaatcagctcagcttcagtccattatgtgtcccggaatatgggctgcgctgcccacttgaggtacaggttgatctttccagatttagccccttctaacggaaaactgtctctcacttccccttccattatgactctcgtcagcgtcatgatgcatcgacccatatagtcctttccaaatgtgtcgtgatcataaacttccaacataagcatatcatgtaaaccatcttcgncgacaaaatcaaaagtctgattccaggttggattcaagctttcatttac

SEQ ID NO: 5136 - DNA, 551 bp, Musa acuminata
tatcttttgtgatttcctcagactacaatgcatgtgtcctctcctggatcaccttcactccaccattgacgtcacacagacatatgagctaacactagtcgaccaaagtcaacgaaagagaggaagcgtcggggtggcagtcctctcaagcctctgtccctcaagagaggatggagtgcagatcgttaggtcgaggttgagatcaggcaacacagtggagctgcacttcttcatgttctcgtggcttgtcacggcatcagtcgacagagatgcactgtgtgagctccgagatcgacggagcggcgccttctgggtcaaccggtggttgtcaggatcgacacccatgctcttgagcttcttcctcaggtgggagttccagtagttcttcacctcgttgtccgttctccccggcagcctcccagctatcaacgaccaccggttgccgagcaacgcgtggagttgatgatgaggtcggttcatcctctttaaagttgcttctcttcacgtccggacgaaggtagttgatccaccggagcctgcaactctcgccg

SEQ ID NO: 5137 - DNA, 464 bp, Musa acuminata
attttatatccctttaccagaaaagcctgcagataactggcaaataaaggatggcaagaaaaatatttcctggtgcatatttccagtacaaagcaaaacacttatttgcatgcgttggtccgcatctttacgttacaaactcatctcccaatgaaagactgcagtgtgtagaactagaaattattcctcaagcaaatcaactttagtccggtaaaaaaggaaagccgaaatcaaaactaggcagtttaacatcaggctcttccgttttagtagggctccacaggtgctcggaactttgctcccgcatagacggctgcagcaccaagctcctcctcgatcctcagcaactggttgtacttagcaaggcgctcagagcggcacggagctccagtcttgatttggcccgtagctaaaccaaccgagaggtcagcaataaaagtatcttccgtctcaccactccggtg

SEQ ID NO: 5138 - DNA, 574 bp, Musa acuminata
  misc_feature (9)..(9): n = any nucleotide
tcttttatnccttactctgtaattgacaggtattcggaacgaaaactaaggcgagtacagaacaagagaacagaaagagcagctcagattgaaatagcacatcattttgtgacatcatcatatctccaaagaaagaagaatcgcatctggtccgattcggagttagattttgggttgcttcgttaatcttctcttgccttttgctgccaattcctgtagtaagaaagattacccactctgcagatcagagccccagtaagatgtagtacaccagcgtgattggcagcgcaatcagcatcccaaatatcaccgctgtgctgaggatatcgggatgcaaattgtactccttcgcaaacacgaaagggacgatgccttgcgggagtgacgcctgcacgatggcgatgcggaggaggacgccgcggagacccacggaaatggaggcggcggccatgacagctgggcctgttaggaatctcacggccatggcaaaagctgccaccgaattcccacatgctatgatcctcggctgcaggccatgaacagccccaggtgaacatggccattccgaggctgc

SEQ ID NO: 5139 - DNA, 557 bp, Musa acuminata
  misc_feature (4)..(5): n = any nucleotide
  misc_feature (15)..(15): n = any nucleotide
aacnntataccacanattgaacttccatgctatcaggtttatacacacaattatacagaaacatccatctccatacttgtagtaacactacatgttggattacaaagctcgaagttgaagaaacaaccaggtttccgggaaaactgctgggatggttacgaatctgttcaacagcatagtccataaagaaagctaataggtactgctgaagactaatgaaaaaaaaagggaagcaaccagatttccgaaaggtgaattggacacaataatgatagatgggtgctagttcttgggtatatttttcccgacaatcttggcaggcgtaattcggagaaggttgcccggctttccaggaacagccccttttatcatgaccactcgcaattcgctgtctattttgacaatcttcagctttcggattttggtcttggttcctcccatccttccgggcatcttctttcccttgtacacacgtccaggagtagtaccagcaccaatcgaacccagggctctgtgactcttggaaccatgagtcatcagtccacgacggaagttgt

SEQ ID NO: 5140 - DNA, 485 bp, Musa acuminata
  misc_feature (4)..(4): n = any nucleotide
  misc_feature (17)..(17): n = any nucleotide
  misc_feature (174)..(203): n = any nucleotide
agcnggaagatggattntcacaaacaaaagtttgtggatacaaaacaaacaggtacatttaccaaataaataccatttcactttatcttactttcgttcctcaacacgattgttgatcttcatggaggtcgactgccgtctttgtccttctgttctccatgaacccatgagctnnnnnnnnnnnnnnnnnnnnnnnnnnnnnngttcgtatactgagactgagatgagaagtccaagaagtgctgtgaagaccctaaagcagaagttgttggcgtctgacaggacaccggcgtgaaggtgccgccgacgtagagccccgaagctacattctgcaagtcttcatccctactctggaggagttgagcgtactgcagcaggtcggggtacgaggtcgcaggcagctgtagcggtactcggggtggctgcctctcggggacccctgggctgacgaggaagccgaggtcggtccggcttggactctctcg

SEQ ID NO: 5141 - DNA, 385 bp, Musa acuminata
  misc_feature (196)..(233): n = any nucleotide
ttagattagttaatcaaatacaatacaatcaatagattatgtgttctttagatcaacgtggacttcattattgatagcaaacatatgggcttcgcgaagaaaccatttgcattgcatcgaccgaaacgtcgatagcgaggcaatccaaacaccgacaacgtataagacacagtccatcccatttggacgcatctgnnnnnnnnnnnnnnnnnnnnnnnnnnnnnnnnnnnnnngataacagcgcttagttcaccacgctgcagaccttcctgacctccccggcggagcagtgagggggctgatgtcgcccatcttcaccatggcagccgcgaagtcggcgaagaaagccgcctggtccttgctgtacgccaccaccgtggcgtcg

SEQ ID NO: 5142 - DNA, 772 bp, Musa acuminata
  misc_feature (80)..(80): n = any nucleotide
  misc_feature (140)..(140): n = any nucleotide
  misc_feature (187)..(187): n = any nucleotide
  misc_feature (194)..(194): n = any nucleotide
  misc_feature (207)..(207): n = any nucleotide
  misc_feature (211)..(211): n = any nucleotide
  misc_feature (220)..(220): n = any nucleotide
  misc_feature (710)..(710): n = any nucleotide
  misc_feature (713)..(713): n = any nucleotide
  misc_feature (748)..(748): n = any nucleotide
  misc_feature (753)..(753): n = any nucleotide
agctcttcaagaagtaatacattcatgatccatgttttcatgctcaaggaaatgagattcaactcggctacatatctggngttctgacaggagagtagttgtgtggtgaatccattttgagtagcaatttcttctatccntgagagatatataagcagcataaggttcctactgaggtagctcacanatatccnggtgtataagtancagntagcatacncaaggttcttggtacaaacctcacacaaaaaagatataatttgttttcgatcggcgtgatgatctaataataagtgtacacctaaatacacacaatatgtgatgtttgacgtaccttataatagtccatgtatcacccatactaaaaaccagaacaagtgacagtgcagctctggaggatgaaaggctagagtatcattacttggccggttttgcctgactggcaacagacatggatcgcaaacgacctgcaatttgagtgaaggatggcctttgtgctggatcaggggcccagcacagctccattagctttctccactccggatcacatgtagctgggcactgggggctcagtgtattattcacgatacctcctataatgggcaccataatgcatgttggcataaggctcttcacccgtgagaatttcccacataacaatgccaaagagaaaacatccactttttcagacaacttgttgctgcttccanttngtaattctggagccatccatgtagcgtgctctganaccancagaaacagagtgtttcgt

SEQ ID NO: 5143 - DNA, 570 bp, Musa acuminata
  misc_feature (5)..(5): n = any nucleotide
  misc_feature (7)..(7): n = any nucleotide
  misc_feature (12)..(12): n = any nucleotide
  misc_feature (27)..(27): n = any nucleotide
  misc_feature (29)..(29): n = any nucleotide
acatngnagtgntaagatttatgttananttatagtcacaaaaatactgagtcacaaaaatactattaaaactagcagattgacacagactatctgcaattagagaactgtctgtggtaattgaaatgaagcaactgttcaatccagagggatgacataggcaagaaacacttaaatcagacaccacaacaaatgtacaggttggagtttcatgaatgatggtaccctgcagttatttggaactcaagaagccctcttgcttttgtacctattagcacaggcaacatatatcaaaagattcaagaagctcagccccgtgagcagccagaagtagtagtcgaggtgcccttcgttcaagttatcgggaatccatcctgtcctcccgcctcgagttgttaccgatgtcacgacagtcaagatgaagggactcaggtagttccccagcgcagtggtaagaagtgataacgcgctgcacagacttctcatagcatcaggagactgatcatagaagaactccagtgacccaatgatgtgaatacttccgtgctccgaccaaaagtttgaggtgtc

SEQ ID NO: 5144 - DNA, 462 bp, Musa acuminata
gcaacattcgatgggttcaaaaatatgccacgccgatgcaaacatacattcgatgagctaccgtctaaaagaactcaaagtctacatacttgcctccacacttcacatctgcccctacaatccttttgctactagttctgaatccttctgcgactccaaattttggtggcagctcaaccacctcgaccggccgtggcacctcaggcggcatactgcatcgaataagtgcccagttcacgccttcaaagaagggatgctgctttatctcggtggctccccgtttcatgcccagacgatgctgaggatccttcgccaggagccctcttatcaaatcttggcttgcgttactggttgatggagtttccgggaatctaagtgctggcctatcacattgaacaatgtcgcccggttgcctgagcccttgaaaggcgtccggccataaagaagctcatgcaggaatat

SEQ ID NO: 5145 - DNA, 547 bp, Musa acuminata
  misc_feature (96)..(96): n = any nucleotide
  misc_feature (384)..(384): n = any nucleotide
  misc_feature (481)..(481): n = any nucleotide
  misc_feature (524)..(524): n = any nucleotide
  misc_feature (532)..(532): n = any nucleotide
cttgatataaattaacagttcacaaatgtactccctatggaaaaactaaatacagggctgagaaggaaacctggctatgttggttggcagattagntagcattgccaaaggggtttaagagaaggggctatacacaaaatggatgtctcctacatgaaatagctcaatgctttcttcttcctcgatcctccttcgccatagagctcattccattgttgaagctcactcatatttgaagattcagatgacacactcgcacacacctgttcattatgcatatttaaagtcttccatgttcagaggacgaacatcctcacttgcatataatgtgggtaaaggtctaccttctgctatggctaaattcttttccttcttttctttctncaaaatctctctaatgggacaatgtgcagcagttacacagagattcttcaagtcacttcctgaatatccatcagtcatatttgcaaagacttcaagntcaacacctggtgccaactcttcttttgacaatataactctgngaatcttntctctgtttaatgca

SEQ ID NO: 5146 - DNA, 340 bp, Musa acuminata
tccctctactgcgctatgttgcagatccaaagacattatggacttggtatgagccatacatcaaggatgatgaggaattctctcctggttctaatggtcgacttacgacaatgggggtatttgtgcgtgatcttcttcttggtcaggttagttatttgatttcctttattgcctgtccttcatagagtatgcctgtcagacaattctttatgagtgtgttattatttaactgatttagtatttcttgctcatatttttgaatcaacaaattccattcatggtctttatctaattacttgttttggtagctgaaaggttagatcgcgagcggccgctcgcg

SEQ ID NO: 5147 - DNA, 480 bp, Musa acuminata
  misc_feature (6)..(6): n = any nucleotide
  misc_feature (377)..(377): n = any nucleotide
  misc_feature (425)..(425): n = any nucleotide
  misc_feature (452)..(452): n = any nucleotide
  misc_feature (466)..(466): n = any nucleotide
acatgntaaatgtcaaagctaaacaaaagttgctgatatttgctaaatccaaaacaaactagtagaaaaacataattttgttacaaaccaaccacaggttcacaatcagaacaacaaaagtcgcagatttagtaaagcatgcatatctgctaacactatgaattcatccaatggaaatggaaggatcactccttggaggacttgttaatgagtgacttgtgaatgtgagggatgactccaccaccagcaatagtgcccttgatgagggtgtcgagctcctcatcccctcgaatggctagctgaagatggcgtggagtaatacgcttcaccttaagatccttgctcgcattccctgcaagctccaatacttcagctgncagatactccaatattgctgccgagtacacagctgccgtggcaccaanacgaccattagcttgaatcctcgactncagttgccgatganttctgccgacaggg

SEQ ID NO: 5148 - DNA, 604 bp, Musa acuminata
  misc_feature (8)..(9): n = any nucleotide
  misc_feature (473)..(473): n = any nucleotide
aagatcanncagtacttctgtcactttaaagacttacagaactggatgcttgcaacatcatcattctgatacattaagactactgcagcaaccttaatttactactacaagctcctgttactgttagcgaggagattaacgacaatggacgaggggtgatccgatgaatcatgatgattacagcaacaatctctagacaccatatagatctgcccactccatcatcatgtagttggtgaaatcgtactcgtttatgcagatgagttcagcttcttctcgctgccattggaggctcgcagctgagaagcacgagctcgggctgccatcgccgctctcgccgttgccgccagaagctccattcatgccggagggagcttccttacctcctcctctgcttccgagagcttctcctttagcttcgacacctcgttctcgaggtggcacttctcgaggacgacagcgtcgtgcgccanttgagctcgacgtaggcctccttcacctgcttgcttttgtgccgcgcccgccggttctggaaccagacggccacctgcttggcgtcgagcccgagcttggcggcgaggtgggcttctcctggcctcaattt

SEQ ID NO: 5149 - DNA, 492 bp, Musa acuminata
  misc_feature (486)..(486): n = any nucleotide
  misc_feature (488)..(488): n = any nucleotide
ggcctttcaagaatctattcagatatcaaatcaccccacaccacatgaaaatacaagtgttttatgttcataatcactgttctttcactttacatgatctttatttttagcaaaaaggtttctctgaactccactaactacccccggtttggtgcagcatagcatcaatctcatcaccatcttccatctcaagttcttctggggtttgttccccgcgcagcctgcggccgtcaaacaggaatgcaatcgaattgatatccaccgactggcgatcacagtaggcattcatgagcttccgcagctgagtgctgtgcttaatcctgaagaagacctcatttccatcctgccccttgaccttgaggttgatgtgcgcggcctgatccgccggcttcttctcctcctcctgacccgacatccttctccctcggctccgcgacctcgatcgagcaaagcagggtgaaggatgtcggggcaggaggaggagangnaaga

SEQ ID NO: 5150 - DNA, 623 bp, Musa acuminata
tagtttcagaaaaaggtataagcagacttcatgtaaaactgacgcaacaataatagttcaaaaataagagggcatggcccatgacatacggccaatagcaaccccaacagttcaaatttgacattcaatgaaactaaagcgagaacgagataccattgagacaacatcaaggacggccgaacttaatccacctcctcaatcttgggacctgcaccactggcaccagcagagggtgcgtcatcatccattccaccacccatgtcagcaccggcaccctgatacatcttggcgatgatggggttgcaaatgctctccagctccttcatcttgtcttcgaactcgtcagcttctgccaactgattgccgtcgagccactggattgcctgatcaatggcatcctcgatcttcttcttatcggcagctgcaagcttggatgcaatcttatcatccttgatggtgtttctcatgttgtaagagtagttctccagagcattcttagcctccaccttcttcttgtgctcctcgtcctccgacttgtacttctccgcttcttgcaccatcttctcgatgtcctccttgctgagcctacccttgtcattggtgatggtgatcttgttcttctg

SEQ ID NO: 5151 - DNA, 563 bp, Musa acuminata
ttccgaactattatacattcagatcatgccatgagagctcagtttgatcttttagggtcttcaaatacaacatgaaggagaaggattgttattcttagttctcataaacatattacacatctcagtttggattggaggtgggggtgctgtcaacccatagcatacttctgcgtccatgctcgagctgtctcttcgtattgagacctctgcatcttgtacgtgtgggcgatctcagggacgagaggatcgtcaggattggggtctgtaagaagggaggagatggagaggaggacctttgatatcgtcagtgcagggctccactgctccttgaggatgtcgaggcagatgcttccgttcgagttgatattggggtgataaacctttgtctggaagttgacttttggaggcttaaatggatagtcaggtggaaaatgtatcttaacaaagaacactccacctgcataaggactgtctgcaggacccatgattgttgcctgccattggaagagatcttccccaacaggtccagcactgcatgatgttggaggatccctctgcaatcc

SEQ ID NO: 5152 - DNA, 553 bp, Musa acuminata
  misc_feature (114)..(114): n = any nucleotide
  misc_feature (389)..(389): n = any nucleotide
  misc_feature (417)..(417): n = any nucleotide
  misc_feature (420)..(420): n = any nucleotide
  misc_feature (433)..(433): n = any nucleotide
  misc_feature (443)..(443): n = any nucleotide
  misc_feature (445)..(445): n = any nucleotide
atccttcatgcagtttatatcacaacaaataagacaaattaatgcaagaacatcatcatctgcttacacacatatatcatgtgccatctctgatttttaattagttgatatggngaagaacagaaaagagttttctctacatctcactctcatctatccagggaacttatggccacccagtcatagacggtggggcttctcggctcggcggtctccaccccctcggccaccggcgtcggcttcctccggagcctcttccagtctcccctcggcgtcggaggggaaagaggggaatcaagggcgctccacgggccccgaggcgacgaggcggcagaagacgtcggtgagggcggtgcggcggaggcgctgccccggaggatggtgatgcnccgagtgactgaagagcgacgggagctnctnctgctgcggcggnggcaacaaananttaggaaggggagaaggaggaggacttccggagcttgccgaggccggtgtccggtggcggcccggcgacggtgtcgtcccacaggtggtggagaagactcattcttcc

SEQ ID NO: 5153 - DNA, 612 bp, Musa acuminata
  misc_feature (5)..(5): n = any nucleotide
  misc_feature (14)..(14): n = any nucleotide
  misc_feature (590)..(590): n = any nucleotide
gaaanaacaagaantgattgaactttactaagagtttgcaaccacggtaatcaagacgagtcgttagatcaaaatccgaacaacgcaggagaatttgatgtccagatcacctcttaggctacggaactaaccgacaggatcaagcggtgagcacgacggcgccgcctgcggcctttatcttcttctctgcgatcttggagatgagcttggccttcacgacgacggagcggcccgggggcagcatccccttgccgaggaccttgaagtatccgaactgggttacgtcgatgaggggggcggcggcggcgtccttagcggcagcgttccttgacggcgtcggggacgagggaccagaggcggtcgacgttgagggcggggcagtggaacttgttgcgtaggcggtggaagtagcgcataccgacctttccgaagtaaccagggtggtacttgtcgaacaggatgcggtggtggtgcatgcctccggcgttgccgcggccaccggggtgcttccggtgcttcccgatgcgtccgtgtccggcgctcacgtgccccctcttcttccggttcttcttgaagcgggtctcatggcngtggacggcggttcttagtctc

SEQ ID NO: 5154 - DNA, 573 bp, Musa acuminata
  misc_feature (41)..(41): n = any nucleotide
  misc_feature (120)..(120): n = any nucleotide
  misc_feature (284)..(304): n = any nucleotide
  misc_feature (490)..(490): n = any nucleotide
  misc_feature (512)..(512): n = any nucleotide
  misc_feature (518)..(518): n = any nucleotide
  misc_feature (533)..(533): n = any nucleotide
  misc_feature (535)..(535): n = any nucleotide
  misc_feature (538)..(538): n = any nucleotide
  misc_feature (543)..(543): n = any nucleotide
  misc_feature (553)..(553): n = any nucleotide
ccaaatattacatcgtgcacaaaatataattagggcaagcnatcatcggttgaagtaatgcatgctgatgctgcgcaacttattctcgacaagcatacgtactacgatacaatgaaagtnacacacaacgcagttcatcgtgggaatccttcatgggtgtccaccgccaccagctcctccaccgtagccgccgcctgacccaccaccgccaccgtaaccgcctccagcgccgcctccatacccaccgccagcgccagttcctcctccgtagcctccgccttgtnnnnnnnnnnnnnnnnnnnnntagcctcctcctccacccccaccatacccaccgccgccaccatacccagctccaccaccatatccacctccgtacccggcgccgccaccatacccacctccaccaccataaccacctccgccaccgtatccacctcctccgccggagccacccccatggccacgacctttgtggaaccagctcttntcctccaaaggcgtttgtagcnagtttnctggcaccggcgganantanagggngccaaagagnaggaggaggaagagttggcc

SEQ ID NO: 5155 - DNA, 539 bp, Musa acuminata
attctgtaatagcaaatgtctcaattgcatgaactgagaattctaaactagaagtgatataagagagcagatcacagtaaaccaataaaattgtacttctacacaaaggaggagttcagcttcttgagattgcacaagttcctgatgctcatgtgaacgaattcaagtcaattgaaaagtttaagatcttcaatactaacaatctatgggtgaacttgaaggccattaagcgacttgttgaagctgatgcacttaaaatggagattattccaaaccctaaggaagtagatggtgtaaaagttcttcaactggaaactgcagctggagcagcaattcgattctttgaccatgcaattgggattaatgttcctcgatctcggtttcttccagtgaaggcaacctcagatttgctgctagtacagtctgatctgtatatgttggttgatggttttgttattcgcaataaagctagaacaaatccctcaaatccttcaattgaacttgggcctgaatttaagaaggttgccaacttccttagt

SEQ ID NO: 5156 - DNA, 460 bp, Musa acuminata
  misc_feature (30)..(30): n = any nucleotide
  misc_feature (32)..(33): n = any nucleotide
tcatgaaatagataaagcacatggttgggnanngaaatcaactcaattgttcataagcactcatccccatagaaaacattgcatgcaaacccctcgacgataagagtcgttgcatgctcaaggttgaggtgatgtatcaaaatcacattctatcttcccttctccgtggagcgcaagtgataatctcgtcaaccctcaatatcatctcagctgcctcggttgccgacaaaagaacagcttgcttcaccttgaaggcctctgatatccctagtttgtccatatctccaacaccaccagatatgatgtcaattcctgcgttagttgtgtccttgtgatgctcagctcgaagttgagagataagctcagcactgtccaaaccagcattgtcagcaatgattgtaggtattgcttggagtgatcgcgagaaagcctcaatggcatgagatttcttccctggagt

SEQ ID NO: 5157 - DNA, 532 bp, Musa acuminata
aacatcacttggataaaagataaatcaaacaaaaaaactgcgatatccaaagcacatgtaccatcgtctttagcacttgacctccttcaatccataggcaaaatacaaaaacgtcggatcagtggcgccatccttgtaataagcaaacaccatgctgccatcctcatgcatactttcaccaacaaaaaactgtagatctttgagctttgaaagcaagaacttggtggctccttcaatgtgtttcttaaacaactcttgcttctcttcatcaagtttaggtgtcagtagcttgatatagcgtttcatataggtcacaaattgcttcttatcaaaggctggttgttcctgaagcctaaatgtgtcgactatgtcaaccactttaacagctgaatcatcgactccctcgtcttcaccgccttcagcagaagggtttgctccgatgtctacatcaatagctcctttaacaacccactttccttggacttcccacaacgtcccattttcaatttccttacaatgaaatgaatcggac

SEQ ID NO: 5158 - DNA, 586 bp, Musa acuminata
  misc_feature (10)..(10): n = any nucleotide
gcaatatttnttattcatctcaaaaaggcatcatcgtatggttcatgttcatgatgctcaacagtattttattggtttcttaccacccgggtgcatgcttctgtcaccaacacattactatgcttattgttccacgcacaagtactagtctgatttcttagaaaaaccaggatttacacttgggaacccgcaagccgtctcctgcttgcgtttgaaactgccacctgaccaagcttgtcagtcgtttctgataccatccgctctctgaccggagtataatgacgaaaccattcaccggtgtaaacctgttgaggtctcataatctttgtatcaggatcatcaagtgattcccgccagtgtgctaggtaaccagccatacgagggattgcaaacagaacaggaaagaactctgtcggaaatcccactgccctatagattaagcctgaataaaaatcaacatttggataaagcttcctcttgataaaataatcatcagatagagcagctttctccagtgccacagctacctcaatcaaaggatcccgcccaacaatcgagaaaacttcctcagccaacttgcggatga

SEQ ID NO: 5159 - DNA, 529 bp, Musa acuminata
atgtctgcatttatgaaaggaattcgatccaccgaacacattattgatgttaaagacacatgatacatagatcagactaacagagatccaaccattacagtcacagcttctccctgaatgcatacacgctgagtctcctccacaagttgaaggtccaatcttccacctcttggagaagccatgtaagcgatgaggtttgttttccccagctttttgctccagtagggggctagagcacaatgtgcgcttccacaaacaggatcctcatttattccaaactttgggcagaagaaacgagtaaaaatgtcatattcagatcctggaggggcaggtgcagttacaataaggcctcttccagcacacttctgtatctcatcaaagtttggatgtaaatcaacgacttcctttcctgaagaaagttctacaatgagatcatgactggtctctgttttctgaacgttgactatcgatgcaccatttagtgtctccgtaattgatggcatctctgcagcattgcatcctcccactg

SEQ ID NO: 5160 - DNA, 610 bp, Musa acuminata
cccatattgcttctcattcactgaatgctttatttttcacacaatctatagttgtgttcgtctgatcaatgatacgtcaatcatcatgcagcgtatttcctcgagccaagagtctcagagatggcccttaacgaagtcgatgagaagctggttcacttgctccgggaactgctcctgcacaaaatggcttccttcggggacgtagacgatctccagatcagggacgaattgcttcaccgtgccgctcctgacgtagtcctccatggccggaaacctgagaacgtagtctttttctcccatgatcagcagcgcagggacttcaactttcggatcggctggggccgttaccttgagcagcgaccggtatggcatatggagcggaaatcgaaaccccgaggtctcgtatagagcagcatagacatcgacgtcttcctcggtgcaccactgcggcaagggcgtggatgagtcggcaaggtccatgatctcctggcctctctcggctatgggaatctcaaccctggagaatagaatatagatggtgcgaacgactctcctgacatcgaaccggcgaagtctgcctccgctcgactggctccgcaccgcagtatgt

SEQ ID NO: 5161 - DNA, 589 bp, Musa acuminata
  misc_feature (16)..(16): n = any nucleotide
aagacattttcaatangtgcccgtttcaacacaagtcaatgaatttgaaacttctagttgtgcatccaagcaagtttttggacggatcgacattattcgtccatcagttccgaagtctatctcctgaagggaattcataaaaacaagaaaaagagtgtaaccagatgaggcactagaatgaaattacaagattaggcaatgagaaaacccccgagcttcgcgtcaatcaagatgccatcggatgtgcggcgatgtactcgacggcgagggggcaggaaacgatctggtcggcctccttgtcggggatctccagcttgaactcctcctccagagccatcacaatctccacattgtccaagctatccagccccagatccgtctggaaatgcacgtccggtgtcaccttggcgggatcgaccttggggaagctcttgacgacgtcgaggacccgatcgaccacctcctcacgggtgagatggtcgtcgccgtgggacgacatcgatcgaatcgaggtctgaaaggcatgagagggatctcaaccggtctagggttcggatcgggacgcggacgtgaccaaaggatcgcccct

SEQ ID NO: 5162 - DNA, 584 bp, Musa acuminata
  misc_feature (580)..(580): n = any nucleotide
taaaacaacatgtcagacgatgcttacatgtccaataccaccaatgtgtaaaaccttacatgagtcatcttcctctttctgataaaagagtttcgaacaaaatctttaacaatgtgccacaacaaagaaaaatccaagaatggaagtgttgtcaaggagggggctttacttccacttgtagcttcccgtcgtagaaaccaagaaactgatgctgtagatctttccatgtggggatcaaaaagaagcaacttggaaaaacagcaaaaagcaatttaggcatgtttacctgacctctgctgcatgatccttaaagagaccctactggtaataacttgacgactgcagcaatgggcattcctaagaacccaaggaaaacagttacaaaccactgtgacattgtaagtggtatcgtgtttgcaaagtccccaagaaattggacaattataaattgaaagacgacggtgctgatgagaacggccagaaagacatagttctgcaagatgccccggaatacatttatcttctccatctctctagagcttatctcattgaacacctgacagaaaacaaacgaattgantgtg

SEQ ID NO: 5163 - DNA, 524 bp, Musa acuminata
attttcacagtaattatgcaattatttaagaacgttaagtgtaagaaggcatgacaatgcatattccaagaacatggttctacatgacaaagatattaatggatactcttgtgaaccctagcaatacaatcacaaaacaagatatgaatgcttgacgacaataaagcagatactactgttactcctcgcaaacctccatctgagacctcatgcaatggattgaagagctctatcaaaattatcttcggcggatgccatacgagcaacgagaacatggtctggatgtgacaacttcaactgattgagatatcgtgatgatggtttgcctaggtgaagactgcacacagcaaggttggccagagtttctgcatcctttgcatctttgttcagtgcttcaagcaacaaggactcagcctcatcaaagcgacccatgtgcatacaacagacggccttgccattcaaaatcattccagtcatctgatacttttcagagaagtcttggaaaataagatatgctcctgtat

SEQ ID NO: 5164 - DNA, 523 bp, Musa acuminata
  misc_feature (3)..(5): n = any nucleotide
  misc_feature (334)..(334): n = any nucleotide
  misc_feature (352)..(352): n = any nucleotide
  misc_feature (375)..(375): n = any nucleotide
  misc_feature (451)..(451): n = any nucleotide
  misc_feature (500)..(500): n = any nucleotide
atnnnctagcatcaaccttaacatttcaaatatcatatttacccttccaatgggttctcaggaaaaataaaatacattaaaaagcacgaagaaattaagaaacagctacatgtgagaatctaaatgtccttggcagctgcattaggattcccaagagctgcaatcaaagaaaacttgccgaatgagacaggttgaaatctcactttgcatggttccatactctatacgatgagaatgcattggagtcatgcatcttcctcatcaatcaagatcttcttgcacgcctcgtagcacatgaatgagatgcctgcagcaggcaccaacttcatgcaangtggccccaaccctttgnaaagacccccaaccccttccttntccagtatgctcaggagagcatgtagcatgttcttgtacacctacccaccaccaacagctccgacttgcatatgcntccgagcaacctcaagtgggaagtagcactgctcgatatgggctccagntgctgaaccaatcagaagtgtgg

SEQ ID NO: 5165 - DNA, 698 bp, Musa acuminata
  misc_feature (4)..(4): n = any nucleotide
  misc_feature (635)..(635): n = any nucleotide
cacncgtacatgaaggttgcacgtctataatcattcgtacaaataaaagtgcagtgacaaattattgaggatgtagtgtgagttaacaaacaacaagactctcatccgaggagagtcatttgaataaattacattatgataacaaaaaagttgcagaaatatactacggcgagcacactcgtcatgtgtttcttactccgctcgagattgaccagcccgagaagaaagaataatgccaacgataagaccatagagcgcgagagcttccgcaaagatgagaataagaatcatacctacgaagagctttgggctgctgcgcgttggcccttactccagcatcgcccacgatgccgatcgccatcccagccgaaagtcctgcaaggccacaagccaacccagacgagaggtgcgcgtacccgtcaaagagatagtacgacttggccttggggttgatcccggtactgatgatcaccgcaatgatgagaccatagatcccaagcactccagccatgacgacgggcacgatcgacttcatcaccagctccgggcgcatcacacccatggacgccacaaccgacgccgctcttcgccgtcccgtacgccgcccccatgcaggagaaaacgagggccgcggnagcgccgagggaacccgaagaagggggcagtttcgtcgccgctgaacgtcgacatctttgcgg

SEQ ID NO: 5166 - DNA, 449 bp, Musa acuminata
  misc_feature (4)..(4): n = any nucleotide
tcantgttttcaagataaaattaaattcatctgacaggtctttgccccagacgatgagtttcgcacagggaatggtatccgccggttggtccagaaacagaaaaatttacatgcataatcatggtcactgctaagaaagtaggaaagacgggtactctcactgtgtaagcaacttggagtcacaagcaacaatcttcactctcttcacttgttccaggcggtcctcacttttgaaaactgcatcttgcaagatgaatgtccacacattgtcacaaaacctgtaggtgtgcagatgacccttgacagaaaccttgctcttcacttgggtctccaaggcctctgtcatagacttatcaaactgcacaagcacttgataagctagctctgggctcaaagttccagtagataccatctcatctaaggtttccgtcaagcacatgccaatggag

SEQ ID NO: 5167 - DNA, 603 bp, Musa acuminata
ctccttttggacccaaggcccgcctagcgggccgatccgggcggaagacattgtcaggtggggagtttggctggggcggcacatctgttaaaagataacgcaggtgtcctaagatgagctcaacgagaacagaaatctcgtgtggaacaaaagggtaaaagctcgtttgattctgatttccagtacgaatacgaaccgtgaaagcgtggcctatcgatcctttagaccttcggaatttgaagctagaggtgtcagaaaagttaccacagggataactggcttgtggcagccaagcgttcatagcgacgttgctttttgatccttcgatgtcggctcttcctatcattgtgaagcagaattcaccaagtgttggattgttcacccaccaatagggaacgtgagctgggtttagaccgtcgtgagacaggttagttttaccctactgatgatcgtgccgcgatagtaattcaacctagtacgagaggaaccgttgattcacacaattggtcatcgcgcttggttgaaaagccagtggcgcgaagtaaccgtgtgtcggattatgactgaacgcctctaagtcagaatcctagctagcaaccggcg

SEQ ID NO: 5168 - DNA, 660 bp, Musa acuminata
agtaaaaatttgccccctacacccgtcgaacatgcaatccatatttaaacgtcaatcttgatccatccataaaaggattagagtcgcgcagaaacaacaaaacaacgagggaaacaaggattagagcgctatgctttcacatagaacacttgaatgttcaaagaactcctacgcagcagcaatcggaggcgtagtcagttcatcgaattgaggctttggctccaagtcgataaactggttggatttactagctagatgcgagatgctaactcttccttgccgtttgatgtagtcggcgactgctctcatttcctcaggtgaaatgtatatgtacttcccacggtcatccatgacaccggataatctccccatgctctccaatgtcattatccgattgatgcagtcctgcgttcgtaatttgaattctgctgcaaggtcctccagaggaacacatttctgtttcttgatgtattcaacaaaatttgcaagtaaaccctggttatcatctcgcgtctcaatctctgttgtaccttcagcatcaacagaaaattcccctttccacttttcaaactccaaagccgcagcttcctcatccttggcttctgagccatagttcttcttccatcaaacgctcttgtgttaagctcctcatcctttctc

SEQ ID NO: 5169 - DNA, 634 bp, Musa acuminata
tcatcattttgctctaataatccactttaggtttcacaattgaaacaacaaaatcactcgatctaacgaagcacacgtatccactaactgcaaatccatccaacgaaaatgacacagtcactctttcgaagacttgttaatgagggacttgtgaatgtgggggatgactccaccaccagcaatagtgcccttaatgagagtatcaagctcctcatctcctcgaatggctagctgaaggtggcgtggagtgatacgcttcaccttgagatccttgctcgcattcccagcaagctccaacacttctgctgtcaagtactccaatattgctgctgagtagacagctgcagttgctccaacccgaccatttgcttgaatcctcaacttcaattgccgatggatacggccaacaggaaactgcaaaccggctcgggcagaccgggataccggcttcttcttgtccttgtccttgttcgccgccgtcgtccttgacggacatgagtcccttgatcccaccgcagcggctgtggccgatcaccattatgttctccaccttgagatggagcacagcgtactcgatggcgggcccaactccggcgtacttaacctggtcatagggagggaccatgttggcgcg

SEQ ID NO: 5170 - DNA, 639 bp, Musa acuminata
ataaataccaggaggtacaagacaaatgtcagattaaaatgtcctaaggccgataacacatccccaacacagtcatatcacaaacgagagtgacgcatataagacagaatttagagcaagaaaataaaaacaatagcgagatattgatacggattcaggcaatcacggatcacttccacttcttgaacttgccaccaaacatgccgtgtttcccaccaaacatgccgtgcttgccaaattttccatgcttgaacttgccatggtgcttgaacttgccatggtggccaaagccatggtgcttgaacttgccatggtggcccaagccatggtgcattccatgtcccatctgatgatggccgtgagacaattggtgaaccccgtaagctgccgcagcagctgcagctccccccgccagcatcgctcccatgttagatccatgcccatgatgtgacggagccgatggaccaggataagcagcaggtggatatcccgaaggtgggtatccgcctgatggaggatatccaggataccctgatggtggatagccttgagggggatatccctgagaaggatgtccatgcggaggatatgcaccgggtgcgggaggatatcctgtggagggtatgcccgggtggtggg

SEQ ID NO: 5171 - DNA, 969 bp, Musa acuminata
  misc_feature (4)..(4): n = any nucleotide
  misc_feature (6)..(6): n = any nucleotide
  misc_feature (10)..(10): n = any nucleotide
  misc_feature (954)..(954): n = any nucleotide
ttcntncctnattcagttagggtatcacttaacttgcagacagaataacttcttgatttttgtacaaatttaacaatgcataagcatgcgtgatgagctacattgttcttcacaaattctgcagacagattatttttgcactcacattttcacagtcatcacacaaatccctgtattcacagaaagaatctatacttatatcaaacatgtgcatggtggctgggcaggatcaccatcaatctggcaagctctgggccgttttttagaattcattagaaagtgcagctgcattccagatccatgatttcttctggcaccagtaatgaacacaaaaggtgtttaaaagcctcaaaacggcactcacagatagcaccaaggtcggacactctgcagtgggatgtcgatttgtgttaaaaataatttatattatgatttcagcagagggatcttgacattccaaataatgttcggacagactcatctccttatttgctagtagagcccctgccttcttaagcatgcatcttctggatatgccgcatcctccacaacatgcttcagcatttccccatttccagaacaaagtcgagtggttaaggttggggataatggagcatatagacttcttgaggcattcctatcaaaatcttttgtcacgtgcaataaaatagtccctgagagaacaacaacgaagccacaaatctcagatatgatgcttccaagaccttgtccgtcccaatccttgaacattataacacttgctacaattgtaagtgtagtaaacatcacatagtatattggagacacaatggctgtattgaaggtatcaagagccttgttaagataattcatttgcgttatcacacatgtgaccactaccagcataaaataccatgtctgtggataaattaactgattcgtgccctcaaaagtcaacttcaaagatgtccctanttctttaacactcat

SEQ ID NO: 5172 - DNA, 588 bp, Musa acuminata
ctttaagaggacatacatacacaatccatcatgatcaacatggctttcttttgtccattttcaagtgaattttaaaccatttctttctcttcatcgggtccctacatttcttttcatcctttgacttcttttcctttgttggacactcttcttcgccattagagccattgaaggcactgctcatcttgctgctacttgaattctgttttaaaggaggaatgatggtgtaggaggcatgaatagcattcctttccttaagaagctcgtcaattgattgcatttcctgtgcatatctgcttgtcatctcggtgaatcgggctaacacctgtcaatctccacatatagagagccagacttgcatgaaagaaaggtcggcaagaacgtgtgagtaaaatagcaccatccaggagatgcatcacaaacctctctatattctgtctcaaacttggacagctcagcccttttggttaatatctttgcctccacatcctgaagcttttccttttctgctgaaaattgttcagcacacataacttctattgtgtagcttacacttttgaagaagttgtcaccatagacagcaaatgt

SEQ ID NO: 5173 - DNA, 665 bp, Musa acuminata
  misc_feature (620)..(620): n = any nucleotide
tgaagtggtatacattattcatcaaccaacaccagtattagttccctatagaaatatgaaaacattgttctttttctacaagaaagcaaaaacattcttcctaagataaaaggatgatcaaacgcacaaggtctggagagtcagcagtcctaccactcactacaccgcaacaagaaagtcttaagttcaacttcatgattgacaagcagcaaataagtttcgttagcttctacatccagtctgcccttacatcttggcatacaaattaatggttgatgaccctcctgctttacttgtctgcacattttgtatagattctatcatggcgacggtagaatcgccgcgctttatgatgctctcgagcaatccaaccttctctagtaatgatccgatattagagtccgcggaactcaccaccttatctgcggtcttcagagcagcacataactttagagttaaagctgtccatgagtggtcggtcccttttaatgactcgatcaactgatcgtagttctcctggaacactcggacgagatctcgagatggtgtgagaagatgaggagaaggagggagctcggcggaggagaggagatcggtctcttgtccgtccccatcgtggngtcaccgtcctcggcgacgtctctcagcagatcgccgtgagagca

SEQ ID NO: 5174 - DNA, 585 bp, Musa acuminata
  misc_feature (4)..(5): n = any nucleotide
  misc_feature (11)..(11): n = any nucleotide
  misc_feature (16)..(16): n = any nucleotide
  misc_feature (20)..(21): n = any nucleotide
  misc_feature (267)..(286): n = any nucleotide
ttanncaacanagatnaacnnacaaaactagttcaagtccacataatataagaagactacgacaagactcggttgagcacaaggcgttctaatccagatcttgacaataatagctacctagttacaaatgacacttcaattttcacaccagacctagcctgattcaagtgagctggctgcggccttgagatccacgtttcatcctagtgtccgtccatggtctgttctgcaactgtaatgaatccgtctttctcctaccactgatannnnnnnnnnnnnnnnnnnntagacatcctcctcctacttttcttcctatcgtagcgcctcatgtatcccatatcatcacaacagctatcaccccaattcctaacactacagcaaaccatcttacaaaaggcgtgtctgcagcaaccggtttctgtggcttatagcctttagcgagcaggtggtttatggatacgtatatgaagaccccagttgcgagtcccatggagatggcgtaaatccagtctgccacgcgggccttgcgtggttgcgtctattatgatgccaatcgccaccccgatgggggctggagattgcaaa

SEQ ID NO: 5175 - DNA, 581 bp, Musa acuminata
  misc_feature (59)..(59): n = any nucleotide
  misc_feature (149)..(149): n = any nucleotide
  misc_feature (267)..(267): n = any nucleotide
  misc_feature (481)..(481): n = any nucleotide
gaaatcgtcaagtagaagaaaaagaacacaacttatcagtacaaatattgatggaagtntcggcctcactcgcattgctctcataacttgtatgtcttatatcactgaagtcaacagaatttaatacctccatagtccatataatggcnataaaattcgttttatgtgctttcagtcacagatatgttttacttcctaataagaagaaccacagtatgtgctgctatacttctgttttctccaagactgtcgaccttctcatgtgtntttgctttcaggttaacgactgaagggtgcgctccaagcagatcacacaaattagacctgatagcctccttatgagggcttacttttggcctttgtagaatcaaagtggcatccaagtttcccagctcataaccagcttcatgcatcagttttacagcttctctcacgaagaccgaagaggcggcggccttccacttgggatcagaatccgganagatctgaccaatatccggaagccccaaagcggccaaaatcgcatcgaccacgcagtaaggaacacatccccatcggagtgcgcctcgagccccggtcgt

SEQ ID NO: 5176 - DNA, 511 bp, Musa acuminata
  misc_feature (345)..(345): n = any nucleotide
ggtcctatacttttgctgaacttatgggaaacaagaaaagatggtaagcacgagaagacgtggtcggcgcacctactagcgacaataaacacgtttcaggattcagtatctataatcttgatcaaagatcgggtagttttcgctccaggatttagattctctttcagacttgcttattagcttttcaaatgcttctggtccattctcttcgatgtatctctcagcagctgataacaaatcatctggtttgtcgaaagtgtccttctttccggggacataccacacgtttactgtctgatggttcacaaataatggcctcacaaaatgttgataaacataagcggnaccattgaagtagggcaagaccaaccagcagctcaacatcaattttgcgtatgaccaaaagggaatccattctagtacttttgcaaaagtaagctcaaacagtgtgataaatgagtacaacacccattaagtgagccattgttggtcatcaacaggagatttggtt

SEQ ID NO: 5177 - DNA, 576 bp, Musa acuminata
ggaggaatgaaaatttcacacatcaaaaggcagtcgtcattttccagatttatgcataaaccacatagaccatacgatccttctagctttactttgacttctttccttgctttttcttcacgacttcatcaatgtacattatacccttgcccttgtaaacttagggaggtttgcagccacggacggcacctgcaaactggtgtactcgcgctttgtttatcccggtacaacaaattatgttgggtttgaagcagaaaactcgaacagcaggaggaacagcgaattccacctcatggctgtaacccagcttcagaaacagttgtcgaccttctgcttcagttcttgctttaaaccccacaccgacaatcttaagaaaccgaaaattttttgcctccattgacagattggaggatcaccatgtgacaaaatctacatattgtgcgatcaacatgatctgaagctgaatttgataacaacctaaaagatccagtccaaaacctaatatgcacatgctggttccatttctgataaccttcgaaaaggcaccaaagggagagatggaagagcgtgtacgcc

SEQ ID NO: 5178 - DNA, 570 bp, Musa acuminata
  misc_feature (5)..(5): n = any nucleotide
  misc_feature (17)..(18): n = any nucleotide
  misc_feature (31)..(31): n = any nucleotide
  misc_feature (548)..(548): n = any nucleotide
  misc_feature (553)..(553): n = any nucleotide
  misc_feature (563)..(563): n = any nucleotide
aacantaccctggattnnatctaagcatcanccatggatctccttctcaagtcacatttattgtcatggcatgcaccatgttcttatcccaagaacacagtgtattattcttggagttattgagtgatcttagtaagggcgctgccccacatagttgcccggaggtttgtagttgcagatgatgaagatggcgccgctgttgcagcgcacacggccgcagccgatggccgtggacgaacgccacacaacctgcgtgtagtggccgcacaccttgttaggggcgcacgtgttgctgttgtagtcgtagtactgcttctcggagacccaggcgttgacggcgtctgccgccgtgtagtcgaggccggagccccagaagatgttctcgccgtacggcccaccggagtgcacgagctggcagtcggccgcccgctggttggcgtagttctgggcgtacgcgcgacggtgttgtcccacgacacgggggcgacgccgacggggcgcgggcggcgttgtgggggctcacgaattcctggggcgagtttgggtangatanccggtgcatncatggca

SEQ ID NO: 5179 - DNA, 886 bp, Musa acuminata
  misc_feature (4)..(5): n = any nucleotide
  misc_feature (209)..(209): n = any nucleotide
  misc_feature (218)..(218): n = any nucleotide
aagnntaatagaaatgtataggaaaattggaaaagcagaattcaggtgtcccaattggttccccttggatgttaggaagttgctttcacgcattcttgacccaaatcctacttccaggatctcaattgcaaagattatgggaaatcctggtttagaaagggacttgatggagggattaataagaaatggcaaaggaacacaagaaattnatcaatccnataccaatgaggatattagttcccccggtaccaatgtgtccgaggacaggcgagagatggggaaacttgctaacttaaatgcttttgacatcatctctctttcagctggatttaatctttctggtctgttcgaggagaccaccacaagagagaagcaagattcatatcttgtcagccggcttctacgattatctcaaagttggaggatgttgcaaaatttttgaagttaaaagtgaagaagaaggatcatggggtgttgaaaatggaaggaacgacgaaagggagaaagggggttttggccattgatgcagagatcttcgaggttacgccagcgtttcatatggtcgagataaaaaagacaaatggagataccctggagtaccagaaaacgtggaaacaggacatcagaccagcccttaaggacattgtctgggcatggcaaggggagcagcagcagtcttaaccttgatgctaaagttgcaacattctgatgcaggaagcagatatgtgtttcgtgcttaagtaataccccccatattctatgtactcggtatttctatctttgttgtctatatgttgctatgctgttttctgaaactatgaaacttgtttaaactggtgctttgctgccgttgtgtgtaatcctcattgacttgttcgaatattat

SEQ ID NO: 5180 - DNA, 601 bp, Musa acuminata
  misc_feature (6)..(6): n = any nucleotide
  misc_feature (9)..(9): n = any nucleotide
  misc_feature (37)..(37): n = any nucleotide
  misc_feature (54)..(54): n = any nucleotide
  misc_feature (79)..(79): n = any nucleotide
  misc_feature (247)..(247): n = any nucleotide
  misc_feature (441)..(441): n = any nucleotide
  misc_feature (581)..(581): n = any nucleotide
tgccgnatnctacagataaaatgtaatgtgatacaantggatccaaaacttctntagcagccatcaaacattgatgcanatcatcacaagcagaagatatgaccaacttcagttaaaaattttgcaacccataccaaataagaagctataattttcagagttttaggaagagacaacatgaagaaagaaagccaaagtcattgtaaataaatcttaacatggatcaaatgcataaaatttctttttntctgcctgatgccttagccttaagagttccaaactcactgacaagttttcctgtgtccttcaatgatcccctcagtgctgacatatccaagtgttgatgactccagtgcctagaacaaggaaaacatgcttgaattgtgacctccaagactaagaactccattgctgctttcaagctgagggagggcgccactnttggcattgccgtcaccctccgcggtaatgtaatgtactcatttcttgaccgactcataaaccttgggctcccaaggaccagagatttccaaggtgtcaatccaaacagttttgatgggcatggaaactatagcatcggnttccgtgatcagagtgtgtt

SEQ ID NO: 5181 - DNA, 634 bp, Musa acuminata
cagcactaaaaagttttgataaagaaactaccatcggcataagagggtaagtgctaaaggatgaataaccataaaaaaacacgtcttcaaaagcagttcatcagtaactatagaaagagtcatataaaactaagtgcataatatggagccaaacaatggttcatctggaaactctagcagatacattattaagaccgaggcttctccttcttttccttgaatagggccaacagggacacaccagaaaccttcacaaccttaaaccttactccaggaatgtcacccacggcatggcccttccttccaaatccagcaatcaagacttcatcattttcttctataaaattcaagcaaccatcattaggaacaaaggctgcaattttcttcccattctttatcagctggactctagcacactttcggatagcggagttgggctgcttggcttcaatgcctatcttctcaagaacaatacccttggcatgcgaagaaccagcaaagggcttcttccactcgttgccgagatgacttttcttgtatgccttgtctgcccatctctgcctcctcctgtgagttttgagcttgcgcccagctcccataccacgagtcttccccatcttgtcgaacgttcgac

SEQ ID NO: 5182 - DNA, 633 bp, Musa acuminata
  misc_feature (606)..(606): n = any nucleotide
  misc_feature (611)..(611): n = any nucleotide
gctgtgatgatattatgcatcttattagttggttgcaccacttctattacatcactcaacagtattagcccaagagaaggctaataccttccatcactcttgacatcttatttgtattgtaggagactagtatatatatctatatgcgtggttgcctgcacgagggcggcttattagtggcgtcagtgatctcaagggcagaagacaaccctgtagttggtgccgccggggcaggtgaaggtgctcgtctgatcgtccttgggatagctgtaggcgtcggggcagtttctcttgaagaaccgggagtagtcggtcgggctgcagctgccggagttgcaacagtactggtccgtcttgaacacggtgcaggggttgttgcagccgcccggcgccttcagcgccccggggcactgcccgttgatgtccgccgcgcaccggatgccgcggcagccgcctgacgtggggctgaagtccattggcacgttgaagccgtcgaccagggagatgtcgaagaagtcgaggttgttgaactggttgagcgcgaactccgccagggtgttgggcgggttgccgtacgccgtgcatgacagcacgccgccgagtagnccgtntgcaccgccggtccgttccgtc

SEQ ID NO: 5183 - DNA, 617 bp, Musa acuminata
  misc_feature (50)..(50): n = any nucleotide
  misc_feature (83)..(83): n = any nucleotide
  misc_feature (93)..(93): n = any nucleotide
  misc_feature (101)..(101): n = any nucleotide
  misc_feature (503)..(503): n = any nucleotide
  misc_feature (510)..(510): n = any nucleotide
  misc_feature (541)..(541): n = any nucleotide
  misc_feature (605)..(605): n = any nucleotide
tcttagcacgagcagaataaggttactcttaaaaggtactgtcatagaanaaactcaggcattgcaaaataaaccaacatatnatagaaagtnataagtcnttttaagaaagcataacaaactaactcttcttagagcctttatctccctagaagatgatccaagactgaagaaaccaagtgtaagatatcatgctatcgctatctctggagccaccaccggtgatggcttgatgtattcttcttcgtcctttgggggatgaatggtgaccagatctggaagaggagtggtaggtccttgctttccctttggatcccagtccaacataatcttgaccttgattccaagaacaccctgtctaaggagaacatgcctcacagcagagtcaatatattcattgactggctgaccagaagaaatcatgtatccatccttgaacttcattgatttagcacgctgggccctaagttttccacttacaatcacctcacatccttttgcancactctncatgacaaacctcaagacaccatagcaggcnctcctcacagcaagacctccgagaagcttgtaacggagtgattcggctgagcatggcacacagnccctattgttca

SEQ ID NO: 5184 - DNA, 622 bp, Musa acuminata
  misc_feature (533)..(533): n = any nucleotide
tttgcaaagatgatagtaattggttaagtgcatagcaattattcgtcacaggagaacaatctcagcaactaaaccggatgatagaagcggctccgtcgtggaggttcttttgcggtggtgttactgagggtttggaggcctgctgttggctgctgaaaccctggagccccactcgagcaactctttgctggtatcatccttagtgcacgatgatctctatgaagcagaggcaatctttcttcgcccccatcgctgcctcgattgcctccttgagctcctcctcacacgtgacctttgcggtccagcaattgccctcgccgttgtggatggcatccaccagaccagtgtagttccagttcttgatgacattgtaaggcccatcatggatctcgacctcaatcgtgtacccgccattgtttatgaggaagatgatggtgttctggccgcacctcagcatcgtcgacacatcctgggctgtcacctgaaagttccatcgccgatgcaggcgatcacgcgtctagatcgcgggcggncgtctagaggatccaagttacgtacgcgtgatgcgacgtatagtcttctaagtgtactaaattcattcactggcgtcgtttacaagtgt

SEQ ID NO: 5185 - DNA, 600 bp, Musa acuminata
  misc_feature (403)..(403): n = any nucleotide
  misc_feature (406)..(406): n = any nucleotide
  misc_feature (468)..(468): n = any nucleotide
  misc_feature (477)..(477): n = any nucleotide
  misc_feature (483)..(483): n = any nucleotide
  misc_feature (489)..(489): n = any nucleotide
  misc_feature (545)..(545): n = any nucleotide
  misc_feature (586)..(586): n = any nucleotide
taatgcaatcacagagtctaacccgaaaacaacaagattattatccatcatccgaaacataggggcaatctaaagtttccatctcaaaatttggttggcactgattgttttgccctaagaacatcagctaaacattcgatcaaaggctaaaagcagatgaaagatgccttcttgcagataatgcacctaaatttttgtccagaacagcaactggtcactcaccttgagacttctggtagacgtatgtgaggccgcactttcggcagtagtggcggtcgaagtggttggccatgaaagtgccggcgccgcactcggcgttggggcactccttccgcagcctggtgaccttgccggtagcgtcgtcgaccttgtagaactggagcacggcgagcttgaccttctnctncttgtgcttgatcttcttgggcttggtgtaggtcttcttcttgcgttcttggcgccgccgcngaggcggangacgangtggangggtggactccttctggatgtttgtagtcggcgagggttcggccgtcctcgagctngcttcccggcgaagatgatgcgtgctggtccggcgggaatnccttccttgtcctg

SEQ ID NO: 5186 - DNA, 731 bp, Musa acuminata
  misc_feature (9)..(9): n = any nucleotide
  misc_feature (15)..(15): n = any nucleotide
  misc_feature (36)..(36): n = any nucleotide
  misc_feature (142)..(142): n = any nucleotide
  misc_feature (160)..(160): n = any nucleotide
  misc_feature (184)..(184): n = any nucleotide
  misc_feature (189)..(189): n = any nucleotide
  misc_feature (417)..(440): n = any nucleotide
  misc_feature (665)..(665): n = any nucleotide
acctcatcntttatngcatcatcatccatcattaangcagaactaaaaaaatgacgaaaacagactgttccaaccgcataaaactaagtccaatttcaaatatttaactttgtgttcagtaatctcatgcctggtttaagantatgtgactactgaacanaaagttaaatatttgaaattgganttagntttcagtagtcacatattcttaaaccaggcatgagattactcgatcactcaccttgcgccttctggtagacgtaggtgaggccgcacttgccgcagtagtggcggtcgaagtggttggccatgaaggttccggcaccgcactcggcgttggggcattccttgcggaggcgggtgaccttgccggttgcgtcgtcgaccttgtagaactggagcacggcgagcttgacnnnnnnnnnnnnnnnnnnnnnnnncttgggcttggtgtaggtcttcttcttgcgcttcttggcaccgccgcggaggcggaggacgaggtggagcgtggactccttctggatgttgtagtcggcgagggttcggccatcctccagctgctttccggcgaagatgagacgctgctgatccggcgggatgccctccttgtcctgaatcttggccttcacgttgtcaatcgtgtccgacgattccacctcganggtgatcgtcttccccgtcagcgtcttcacgaagatctgcatcttgtcgccccaggctgctaccgt

SEQ ID NO: 5187 - DNA, 622 bp, Musa acuminata
  misc_feature (14)..(14): n = any nucleotide
agtagtcgttgttngtcgtcatagtttccaactacatgagacatagagcactccctgcttagatcaacaaaaggttcgaaattaccccaaaaacatccaccatgaccgcttatgactccaaggatgagaaggacgtctggagagcgcggagagttcatcactcaaaggcccactggttctccctacgcacctcttcctcttcctcgggggtgaagtcgttcttgatgttgaaggttttacggatctcctccggtgtcttccccttgatcatgtcagctacggtttggcaagttaaatccagcagccctttaatattcagatagtttgcagccaggataaggtcgaagagggtagcctgatcgaccttgacgaactcggcatcccaggacttgagctcctcgtcggcgagcttggaagagtcatcagaggatttggaggcggcagcagcagaggcgtcgacgtgcttcctgcagtactcgatgaccttggcgaggatcttggaggtcacgttgggaagcgggatgccgttctcagcgcagtcgtcctcgatcatgtgcttgatcgtctgcgactccatggccaccgcctcatcgactcgaacacctcgccatcggagctcttt

SEQ ID NO: 5188 - DNA, 600 bp, Musa acuminata
  misc_feature (592)..(592): n = any nucleotide
tgggtgatcattcggtttccaatcttacatacaacacataaaagtcggacatcaaccacaaggttattaaccaagttcaaaactaaccctaatagatccaccaccacatgggaataaaagaagattaagatgtctgaaggactgcaataagccatcactcgaaagcccattgattctccctccgaacctcttcctcttcctcaggcgtgaagtcgttcttgatgttgaaggttttgcggatctcctctggggtcttgcccttgatcatgtcggccacagtctggcaagtcaaatccagcaggccctttatgtttagataatttgcagccaggatgagatcgaagagggtggcctgatcgaccttcacaaactcggcgtcccaggacttgagctcctcgtcggcgagcttggaggcgtcgtcgggggacttggaggaggcggcggcggaagcgtcgacgtgcttcttgcagtactcgatcaccttggcgaggatcttggaggtaacgttgggaagcgggatgccgttctcggcgcagtcatcctcgatcatgtgcttgatggtctgcgactccatggctaccgcctcgtcganctcgaaca

SEQ ID NO: 5189 - DNA, 649 bp, Musa acuminata
  misc_feature (6)..(6): n = any nucleotide
  misc_feature (22)..(22): n = any nucleotide
  misc_feature (446)..(471): n = any nucleotide
  misc_feature (594)..(594): n = any nucleotide
  misc_feature (640)..(640): n = any nucleotide
acaganatttagtagaatttcnagtcctccaacggagaagaaatcgtatttcatacactaaccaaagaaatcaaaaggaaaccctaaatcaacacatcatagtaaaaggaagcaagatctgagagcagtcatgaccaccaccagaaaccctagaggcggcgagcgctcaggaactggtgaacttggtcacggccttggtgccctcagacacggcgtgcttggcgagctcgccggggaggacgaggcggaccgaggtctggatctcgcgggaggtgatggtgggcttcttgttgtagcgggcgaggcgggcggcctcctgggccagcttctcgaagatgtcgttgatgaaggagttcatgatggacatggccttgctggaaatgccgatgtccgggtgcacctgcttcagcaccttgaagatgtagatcttgtacgtctcgctcccnnnnnnnnnnnnnnnnnnnnnnnnnncgatgggcggcgccgtccttggaaagaggtgcttcccggccttggggctgcttctccgccctcttctccttctcttccgccgcagcaggcttcttctccgccggcttcttctccgccctgggngccattagggaacagagcttgtcgttgcaacgagaaaagatcgacnggaacgctg

SEQ ID NO: 5190 - DNA, 661 bp, Musa acuminata
  misc_feature (26)..(26): n = any nucleotide
  misc_feature (46)..(46): n = any nucleotide
  misc_feature (48)..(48): n = any nucleotide
  misc_feature (51)..(51): n = any nucleotide
  misc_feature (590)..(590): n = any nucleotide
  misc_feature (656)..(656): n = any nucleotide
ataatttcaatattacagtacaacanaacacatgatggctcgattncngcntcccttcacgtaccgttacaccaccatttcagaccaatgctgccatgtaataacaagttgatcacacaatatatcgtcttcctcagccattttaaagtacaaaatccaaccatagtgtttcaaaattaattaatcgataaagcacaagtcaaaacatacagtactcattataaagcaagagtggattcataagcattctaatctaagctttgatggcatactttctcatcgggaagtacatctcctttttcttctcccgttctgtcttcaatgaatcctgatgcttggtgagacggcggcggatggcacgagtcttcttgggacgcagatcgagcgggatgaacttcttgttcttgtaggcctccctcagcgccgccttctgcttctgcgagatcacggtcagcacccgcgcgatcgacaccctaaccaccttaatcttggagagcttgttgggtgcgccaccggtgactttggcgacgcggaggagggaaagctcgttcttgaggtccttcagctgggcctggagctccgccttgggnttcccccgaagctcgtgaaccttaatcctcgccatcggtatagaatcggctcttccccctcgtcgntttct

SEQ ID NO: 5191 - DNA, 443 bp, Musa acuminata
  misc_feature (367)..(367): n = any nucleotide
tatatatttatttatatgacctttcacaaaagatcctgcaaagtataaaagcacaacagggttctgaaacacacgcactacaaacatgcacaaccatccatacagacagtcttattgtacgtatctgcctcctgtatatattttgcgtcgtcaacggaacaactcctccaggctgccgaagtagcctatcatggggtcgaaggcggaggcggaggcggaggcggaggggtagaaggcggacggcagtagtaatggctcccgcatcccctcgtatagggtgttccacggcgcgcgggcttaccgctagaggcatggtatataatctgcgctttcgcttccttcacaggggtcgtctcccctctcgctntgacgaggaagacgatgatgacgagtgtgaggaggagagaagcacgactcttgacgactgtcctcatcctatcgtc

SEQ ID NO: 5192 - DNA, 561 bp, Musa acuminata
  misc_feature (27)..(28): n = any nucleotide
  misc_feature (503)..(503): n = any nucleotide
atatgttgggccctatgaatcctcacnntccccttctccgagatccacctctccggcttgaactccaagcagtcttcgccccatatcccttccaacctcgccatggcgtggagtggaaccaagatctttgtgcctggtccaactccgtggccgcttgggaggacttcatgtcgcagagctgctttgagctcgaagggaaccggaggaaatagcctcagcgactcgcacaaggctgcatgcaagtacactaacttgcccaggtcctctgcgtcaaataccaccagatcatccgagctcgatctctcgtttcgtagagatgctaccttcttcaactcctcgaggatcttgaactccaccatggggttgttgcagagcagccaaaagaaccatgtgagccctgcaccagtcgtgtcccttccggcaagcatgaagttcatggttgtgtccctcaggaacttgtcgaacttgctcgattcttgttgactcatgtgttgttcttcgtngtcggtggtcatcgatgtaagacgacagcagatcgactttttcttcgcttcatgtatg

SEQ ID NO: 5193 - DNA, 482 bp, Musa acuminata
  misc_feature (5)..(5): n = any nucleotide
  misc_feature (354)..(354): n = any nucleotide
  misc_feature (381)..(381): n = any nucleotide
ttatngttgcaaatgaaaagaaaatatcaagcatacaaacacactgcatcctgttacagaacacacacccaagcacagatcgagtcttctcacacttcatcgtagctcccaagccctgcaagttgacgctcatgatacagcgtcgacgacatgagtccacagaagttctcctcatcgaacaccacagtcggagccaccagactattgtatgcctccaccgtgcagctcacggtgagactcgagagcatcgagctgggagactcagaagccgctgcggaggccaccgggggttcgtcggtggactcgtgtactagagaagcgctcaccgtgttcgtgtcggcgacgagggagtcncggccggtgagcttctgcacgagggcncggaacgtggcggcgctggtggtcaccctcatggggttggagatgtagaccaccttgatgggcttcttcttcctgacgatagtttggatagcttgaggcac

SEQ ID NO: 5194 - DNA, 569 bp, Musa acuminata
  misc_feature (485)..(485): n = any nucleotide
taatacactttgtcagatggaagtataaaataaaagaaggatcgatgagtgcttgactagttaactacagcaacagagtagacaagcatggagtcataaatgtaaatatggatttctcggaccatagtagaattctgtttcagatgaaggtagcatttgcataggccctaccactagcagttatcgagaaaccaagtttcaaggacttaactctttggttttgccattggaggaggagtgctggcagtagttcttactgccttcctttctttgaactgcaactcgggcacttgtattgctttatgctctcggcttttgcaggagttatcttcacgcacttgccatggaaccacctttcacatacatcacatgcaatccaaaactcatccgcactgtagcttccaccacaagctccacagagtgtttcgctgtgttcgtcgtcgtcttcaccgtaaccctcatcagctgttttcgagttgcttttnatctggccatcactggtgcgcttggttgccgttttagatttgcttccactgtccatgctagacttctctcttgattgtctccta

SEQ ID NO: 5195 - DNA, 639 bp, Musa acuminata
  misc_feature (7)..(7): n = any nucleotide
  misc_feature (9)..(10): n = any nucleotide
  misc_feature (39)..(39): n = any nucleotide
catgatngnncctacaagtgctcggttcagaggacttgnataaaagaaaacagttttgaacaagtacagaaataccaatagaagtaccaaaagcaggagtttctctttcgctacagaggcaaggcagtaaaaggagcaaaccatgtagtattctttcaagactgaagaatctccgttacatctcttacagggtcgcttgcataaaaatcagcgtgcaagaaaaacttacttggggccaatgtccttcagagcacagatctgttcttcacccattgcagacatcacagtaacaaccagatccttcccctcagcaaacccatccttgagctgcaatgcattcagatggcccaacattaaacaatgtcagactaaggggaagtatccctttcagaggcttttctatctgagcgagcaaattttcatcagttgggagtttcagatcatctttggtgttgccactctcagtcaaaagactcacaaaaccatcttcagatatgtcgatcagttgataatcagtgcgagtaacatgaggaacatcacagttgtgggaggatggcacgatatcctcaagtttttttgcattaaagatgtctatgggaacaaagtgacattttgcgtggcatgcttccagtcttggag

SEQ ID NO: 5196 - DNA, 578 bp, Musa acuminata
  misc_feature (18)..(18): n = any nucleotide
  misc_feature (178)..(202): n = any nucleotide
gcataacgtatgcaaaancctcggaaccaattaatccatctactctacatcacttttcagattaaaagctccagcccttggcaagtaaaaacccctgaaatggttcaaacacttaaagactgctcaacacgactctgtgagacctcactaaacttggacttgaaccaggaaatcctannnnnnnnnnnnnnnnnnnnnnnnnggaagaggctgggcagcggctgcagccagttctgcttcatgctgttgctgtgcagccaggtcaatctggacttctggaggtgcaagagcaggtgattcaacaaagtgaagatttgggtccccagcaagttttctagcaagatacaggaagggcttctcaaagttataattgctctttgcagagatctcatagtactggaggttcttctttctgtggaatgtaacttgcttagctttaacctgcctgttcttcacatcgaccttgttaccacagagaacaataggaatattctcgcagaccctgcacagatcccggtgccatgttgggacatttttgtatgttaacctggcagtaacatcgaacataataatggcac

SEQ ID NO: 5197 - DNA, 573 bp, Musa acuminata
  misc_feature (9)..(9): n = any nucleotide
ctaatttangagtttccaagataagttccaacatttgtgcattttattgcatgacaatggaaacatttcatgtacaaagaagatgcttctcaagaagtagcagaagtaatgggacactcagttttgagctgtttccttggagggcaaggcagacgacttgcagattgggcaccaattcttctgccgaagccattgatcaatgcaggcaacatgatatagatgctcgcatggcagcctgcccacctcctctccatctatataatcctcctgacatatgctgcatttggcatcatcattatcatgataagttattccagggaccagggaggcacatgcatatgtgattctcttgagacattttgtcatctgctcttctgtaagagctgtgctaacagtacccattttctcctccaaagctaatagttcctcgtaggacatattatcgatgtccattctcatgtctctgtgctgatcgtggaaccttagtgcccccaacaatacatttgtctcgagaaccaataattgctcatatgttaactcttcattgcgttcaatccgctctaatgccaatag

SEQ ID NO: 5198 - DNA, 612 bp, Musa acuminata
tctaattccttcgattcatttgtgtaataaacacagttttcggcaaatgagcaagcgttaagatttcagagcaagcattcaacaatagatcatgattagcaatttgatgagttctaagatcggagctaaacaactaaaagactacataaactaatataagacagggcatgaccacaaggttatcttttgcattcagctttacaacatttggcagccaggcaatgtcagaacaatcgtgaaaggtcgcagattctgtctttaaactcctccgtgaatggtaagcagtcgtctcctcaagcaaggttccgtatgtcccaagaatagagcccacctcgaatgacctcatatgtcaacatctccctcccttcctgggaggtgttcctggttttaacatattcccaaatccctttttcttatcagctggtttaagtatctgaaacgaacaggtcagagtgccatctacactcatcaaagcaccagcattatcaaattccccacaatagtttggggcagagaatattgtcaccagttggcgctttgcaaagaattcatagccatcttccacaacctggtgggcacgacagatgagatctagatcatgcttctgaagaa

SEQ ID NO: 5199 - DNA, 605 bp, Musa acuminata
  misc_feature (2)..(2): n = any nucleotide
  misc_feature (5)..(5): n = any nucleotide
anctntttgataatccaattgccagtactactttctcactgttgtacacctttggtcttcaatgcctctcatgacacctaatttggaaggtcaacatactacctatctaaaataataaaccaaatgaaactaccatgacttgaatggggaccatctaaaagcacccacataagcatgcaatagtcaactgtgtcaaccaagaaatcattcttgtcctgctacacaattacacaagaatcaacctcatgctcattcagtaagatcaaacctggaagttctgccactgatgtactgcatgcaaacttcttttgcagttctgtagccagtgaatcagcatccagtaggaaagtttccagacctgagaccctcgtaaccttcttgtttccttgtcgtcgttctgtcatgatctgaatgggtctagcagcacctttgcggacagcaacttcattcccttttgatactctatgatgaacttgcatcctgcttaaaaaagttgatcctagatccttcttgtggatttctgttgggtaagctgagccctttttaacagaccctttgtagagagcatcacacaatgtagcatccagaactaccattgccttatt

SEQ ID NO: 5200 - DNA, 599 bp, Musa acuminata
  misc_feature (11)..(11): n = any nucleotide
ataaaccacanaagaattataagagagctatcacatgtttatcataaacctctacaccaacataccaagaggagctatcaagtacacaaatgaacacggtgtttgtatatagtcatgcagttactaattaatgtctctcataatccagcttacaacactttattcatagtcatatgtactacaaatgtgtgcaagcaagagcgaaggttcagaggctgcgagcatgtgcaatttatgaaagccccaaaagcttcttgatatccttctcgatgctcagaggggatgtggttggggcatagcgatctaccacgcggccatccttgtccaccaagaacttggtgaagttccacttgatgccatccccaaaaatgccacctttgctcgacttcaagaacttatatatgggtgtggcattttgaccattcacatcgaccttgtcaaatatcggatattcagctttgaaacgagtgcaagcaaactcaacaatctcctcattgcttcctggttcttgcccagcaaattggttgcatggaaaagccagaatctcaaaatctttgtcctgtacttctcatatagctgagtcagttcctgtagtttga

SEQ ID NO: 5201 - DNA, 641 bp, Musa acuminata
  misc_feature (567)..(567): n = any nucleotide
  misc_feature (586)..(586): n = any nucleotide
  misc_feature (589)..(589): n = any nucleotide
  misc_feature (624)..(624): n = any nucleotide
  misc_feature (626)..(626): n = any nucleotide
ctcgaccatctacagaaaataatcatgttttcctgtatatcacaaaaagcaattgcctatttacatcaaatagttgttgaattttaccccagattctagtgctgctggggtaaaatttctaggcaattgcctatttacaacaaatacttggcaactgacagtatcctataccaacaagcctcacaaaatcctgaaatcgacctttcaacaatggtggctcaatctcagaagagcatgtaacagatctctcagaaaaatggatcttctgtaatgaagttgttcactgcaagttgacaaatggagttcagaacctttactcgctcagctttactctcgtgttgccaatgacagtcacattttgaagcctcatgaactcagatctcatgaagagtgcatatagtagttcattccatgtatctggaaccccaggtaagcaccagtggctgcagtcctgcctgtggagtggagaaggacccaacttgccaaggtaaaacaaggtaaatgtccgtctttccttcgggctgtcatctgtgtcacattcaacagattcagttctagaaccttggntgcagtagaattttccaanggnacattcctaaagtgggctcaagaaatgtgaccaangntttaaagtaaccgtg

SEQ ID NO: 5202 - DNA, 401 bp, Musa acuminata
  misc_feature (59)..(59): n = any nucleotide
tctatgctaataatcctccatgactacactctatacggagtttaaatgaaaaatcaganaactctgtaaggatcctccacaactacacacgctagaagacacttcatccattataaaacacgttatagaacattttactgttgtttgcactcggcgggccgatcaacttgctcccctccactcttcttctgccttgtagccgactttttcttggacttgccattctcttcttcatcttcatcttcatcatcctcatcctcatcatcttcatcttcatcttcatcctcttcatcttcaccatcctcatcatcctctatttctgcatcatcatcttgaacagcctcccccgtgaaccatgaaactgcatggggaattatcttgtctctaattgtggacccaat

SEQ ID NO: 5203 - DNA, 753 bp, Musa acuminata
tatcatatgggacaaagtttccttttttttttacaaaagaatcgacatgaagtaaatctcaaaacccttatcaacataattatttgcacaaacaacatcgaaaattagacatggcaactcaaactacatcttcgactcacgaacaatctatcgaaaatctaccaaacaatctgactaacaattcttttttttccttctttttgcaagatttttctatcacaaaatggtgaattgcaacttattcgatccgagcaatcagttcaatggtagaatactattggaggaaccttgaatccaaagtccttgaggaagggtattacctgcggctgctccaccaggtccctgtacaaggcgtactccgcctcgtaatcatgcaagtccagctccgccttctggttcgtgtggtaatggtgcttcgcctccgccgacttcccgaagccaaagacgctgacttggtcgcagatccccaaggccagcatcaccgcctgcatccccgacgagtagtggaacatcttctcgtcgtggaccttcgtccactcccccggcggcttccctgttgtgtccacgaacgtcttcagagagtagtacttcacgatccgggcgcagagcatgtcgaaccgcacgtccgtgatgaggagcggcgccttgtgggacgaattgcacacggcgtagtcgaggaaatggacgggttggcagatgtacatgacgatggggacgctcttcgccgtacggatgacagaagcagcccgggct

SEQ ID NO: 5204 - DNA, 557 bp, Musa acuminata
ctttattctttaaccacgtaatgacttcaaaacaaatgttgaccgaagataacaacacacgggcggttacggagtctcgttgactcgatccattgccccctcacttcttgggcgcaaggcggctcttgatatcctccacctccttggtgccgatctggaaggccttggcgaggacgtcgtcgggcaccgtcggggttgccgcgaagagggtggcagcgatggactgggtgccggggagctggctgttgaagccggcgatgacggcggcgggcactgcgccgttgttcttctggaagtggacgagcccacgggggaagacgaagacttcgcccttggtgatggtcttggctatcagcttgttggcggtggtgatgaagcccacgtcgagggtgccgtctaggacgaagacgatctcggtggcgcgcgggtgggtgtggggcgggttcaacccgccgggggcgtagtcgatgcgggacatggacacgcccagggtgttcagcccgggtatcttctcgacgttggcgccggttacgagggagcccatggtgttgttggtg

SEQ ID NO: 5205 - DNA, 677 bp, Musa acuminata
  misc_feature (321)..(340): n = any nucleotide
ttgataattaggtgattcacactctgaatcaaggaagaaagataggacacatagcatcctaatggcggaaagagaagtgacatcattaggctttgattgggagttatgctcatggcgggtgattggatgaactgatctcgagctccgaacaagaacatgtctcgatctcgctacttcttgggcgccaagcggctcttgatcttcttcacgtctctggtcccgatctggaaggccttggagaggacgatgtcgggcaccggctgggtggcggcgaagagggtggcggcgatggattgggtgcccgggaactggctgttgaannnnnnnnnnnnnnnnnnnngaacgtcgccgttgttcttctggaagtggaccaggccgcgggggaagacgaagacgtcgcccttggtgatggtcttggtgatcagcttgttggcggtggtgatgaagcccacgtcgagggtgccgtcgagcacgaagacgatctcggtggcgcgcgggtgggtgtgcggcgggttcaacccgccgggggcgtagtcgacgcgggacatggacacgcacagggtgttgagccccgggatcttctccaacgttggcggccgtaaccaggaacccatggtggtgttggtggcgcccggttggccagcccctggaagaaaaagttccgcctccgtcactcc

SEQ ID NO: 5206 - DNA, 553 bp, Musa acuminata
gttcgctttcggaggtttaaataaggggagataaaacagaagagatgaaaaccaacggctgtgatcgacaattctacgaaagactacaagtttacaatcacccacaagcgcggagatttccttcgacatctccatcaaaccaaagcagaaatgaggaagaagaggaaatcaagccctaatccaacgcgctatctctttcttccactaggcagagcgaggagggccggcgcctatccgccgaagccgtaaagggtgcggccctggcgcttgagggcgtagacgacgtccatggcggtgacggtcttgcggcgggcgtgctccgtgtaggtgacggcgtcgcggatgacgttctccaggaagatcttgagcacgccgcgggtctcctcgtagatgagccccgagatgcgcttcaccccaccccgccgggccagtcgccggatcgccggcttcgtgatcccctggatgttgtcccgcagcaccttccgatgccgcttcgccccgcccttccccaaacccttccctcccttcccgcgtcccgacatctctttctccc

SEQ ID NO: 5207 - DNA, 619 bp, Musa acuminata
  misc_feature (11)..(11): n = any nucleotide
  misc_feature (61)..(61): n = any nucleotide
  misc_feature (561)..(561): n = any nucleotide
tctatttattnatacattatttatactgtcttacattcttgatgagagatctactactggntgcaagatcttcacgtgcacattacaggagcgacgggacccattatacaacgaatagcacccactgaattgaatctcctatatcatcctatcaatacgagcgagttgcaccttagcagcgacttatcagtctcaacaactagtcccagtacttgatcatgccatcccatccacaagttgcaaccttgctctgctccaatggatgccactcacatccaatgcatactccttcatggcacttcaaagtcctaaagaccttgcaactcttccagtcccagaaccaacacttcccttctccatctcctgacaggacaaaccgcccatctggagaaaaattcacctggcaagcataccccgctacaatgtgccctgcaaacctcttcttcttattcagctgaaaccgctccttcgtgccatagataagtatctgattgtccaagatctgagcagcagcaatttgaattaggatgaagagagatcaaggcatggaatgcatgtgangtcactaatgtactttacacactgggattccaatttccaaacacgaggacttgtcatc

SEQ ID NO: 5208 - DNA, 612 bp, Musa acuminata
  misc_feature (6)..(6): n = any nucleotide
  misc_feature (536)..(536): n = any nucleotide
  misc_feature (605)..(605): n = any nucleotide
gcattnacctctgtgtttcacaaccaataaaacttacaaagactaaatgcaaacacacctttaccattagaagtcctaagcaaaaaacagaagaaaaaacaggaagaggaggtacctcagcacaagctataaaagcaaacaaaaaatgttttgtgacagtaatttgttccagtcaacaacatctttaagataaagaaattcttggcttttccacatcaaaaggcagcacgccgtggcctctcctcagcaacattaactcttagtgcccgaccatcgaaactctgtccatcaagagcagcaattgcatcatccatttcagactgtgctgccattttaacaaagccaaaaccacgtgaccgtccagtctctctatcatacaccacccttgcttccagcactttaccatgttcactaaaaatttgccctaggcggccatcatccacttgccaaggcaaattgccaacatagatccttaaagatggttgaaattgtcgaggtgttctttccacacgtctccctctgggagctgatttgtntacagtcaaaagcctgccactatttcagaacgatgcagcatcttccacagctttgtctgcttcttcaancgtgctc

SEQ ID NO: 5209 - DNA, 611 bp, Musa acuminata
  misc_feature (4)..(4): n = any nucleotide
  misc_feature (6)..(6): n = any nucleotide
agcnanatcatcatatcagataagggttacaatcttgttcgtaccagcaacaacactcacataatttacgaatttaaaaagcacacaagcatattcgtacttataaccaaattccagaagcagatttacgcataaaattaattgaaaaaggaacgtatcatcaccaagaaatcattcatgagattgggcgacgcaaaggaaaacccccattcacttagatcttgtcgatgtcctcatcctcgaactcgatgtaatcatcggcagcgccctcgtcctcctcgtcgaggcctccgatgccctcgttgagacgaatgttctcgggcagctcaccgtacgccttgaggagtcgggcctcgtcgggcatgtacttgaagatgacatcggccttatcgtcctggtagtcgcggaggccgaccaggataatgtccccggccgcgatccagaccttcttgtgcatcttgccacggatgtggcagagccgcttgctgccgtcgatgcacatggtctcgcagcggccgttgccgagcatccgaagcacctgagcgtactcctggccgtcctccttgaagaccagctcgcgcttctcgtcgtccgctcgttcttcctcgttg

SEQ ID NO: 5210 - DNA, 383 bp, Musa acuminata
  misc_feature (4)..(4): n = any nucleotide
  misc_feature (7)..(7): n = any nucleotide
  misc_feature (23)..(23): n = any nucleotide
gtcnatngttgagatccaacaanatacaatttttttcttagccaaatgcaacaaggtaataaggccacccaaagtgtgcagggcagaccgagaaacacgcaacccacaaactattctacgtgaacgcagacggccactgcttcatgctcctatacagcactggaagtagcccataaacttcttcctcccggtgggtgagccgtggtggtggtggatggggcggcgtaggtcgggctcgggaaggctgtggcgtggcgcctcctgctcctccttgttggtggtgccggatcggagctcgtcgtcgtttccgaggctggcgcgggaggtgttcttgttctgcttccgcatctcccggatcttggtgaagtccatggagtagtccg

SEQ ID NO: 5211 - DNA, 520 bp, Musa acuminata
  misc_feature (10)..(10): n = any nucleotide
  misc_feature (12)..(12): n = any nucleotide
  misc_feature (18)..(19): n = any nucleotide
  misc_feature (445)..(445): n = any nucleotide
  misc_feature (497)..(497): n = any nucleotide
tcataaattntncccagnntcgaagcctgtcatattagcataagtggcgtcgcatatcgtgacagtagtttattattgaaccgacgacaaacaccgaacacagagacatgaagtcgaacatcgacataagaacacttggaacagactcgaacccaatgcagaccaacagacacggatcactcgagactccaggacaatgcagcagcggcggcggcggatgagcagggcattagctcactggccaccacggaggcggagcacgaggtggagggtggactccttctgaatgttatagtcggccaaggtgcggccgtcttcgagctgcttaccagcgaagatgagcctctgctggtcgggggggatcccctccttgtcttggatcttggccttgacattgtcgatggtgtcggaggattcaacctctagggtgatggtcttgccagtnagggttttcacgaagatctgcatcttgggtgaggaaaaagggaactcgaaanttgttctagatcgcgagcggccg

SEQ ID NO: 5212 - DNA, 660 bp, Musa acuminata
  misc_feature (27)..(27): n = any nucleotide
aaaccctatcctagtcgtaatcattcntttgccaaggtaatctgcattaattacatcatcactgtgccagcttccttgttctaagcttctgatacagcaacagtaatctgttctttagctgctatagttcttgcaaacaagaagaagaagaatgatacagacatgcaacaaacacttggctaattcaccaccactacctcctccgtcttctgtttgatgaagaaaatgatctaaaagaactggtcttgatgaggaaagttgtcggagagaggagtggggtggcggcggcggcaggctagaagatgtcgaggatctcgaggatgtagccgttgcagagtgggcagctgccgcggttgacccaaagctcccgggagcacagccggcagaaggtgtggccgcaggggatgaaggccgcccccttgtgccgcaccatgcacacgcaacacacgtacattgtgccgctgccgacgtcctccagcgcccacttcgtcgtcctcctcggccacgaggggctgccgccagcgccgccgctgccggagaggaccctttcccctccgctgcttccacagcctgtccgtctgctccagcagggccatcagcgagaccctcgctggctgctgtcctccttcccagtcgccgcgtcggggtgccccaacgatc

SEQ ID NO: 5213 - DNA, 566 bp, Musa acuminata
  misc_feature (375)..(375): n = any nucleotide
aatgaatgaatattgatcaacagtgaaatgggaaatggacccaatacatcaacaagcccaaagtatctctatatgctcctccaagaaaagagttcttaaatttagagccatcaggagaagaaatttgctggaagcagcaatggaattcacatattgtcgagttcctctgtggatttcttgtattctggcttcagttcatgggttccttgatttggtcctctcttattatagacgcaaagatcatttagtatctctttcaggaattgctcaggttgatcagtctcttggaccagttgcttcagtgcccaattttgttgcctttcaaagagcttaaagatgatattctccaattcacgacggtccctacgtgttcgntttgcatccgatccttttgttggtgttagtttcttcttgtcctttgaacccgatggaaccagagcaaccataccgggcataggctcataagcactccatgatctttgtcaattactgcacttgtctagttttgatcatagctttgttagtctttcacgacataattaccatagtcactaaaattctcactg

SEQ ID NO: 5214 - DNA, 1265 bp, Musa acuminata
  misc_feature (10)..(10): n = any nucleotide
  misc_feature (778)..(778): n = any nucleotide
  misc_feature (813)..(813): n = any nucleotide
  misc_feature (819)..(819): n = any nucleotide
  misc_feature (827)..(827): n = any nucleotide
  misc_feature (843)..(843): n = any nucleotide
  misc_feature (871)..(871): n = any nucleotide
  misc_feature (897)..(897): n = any nucleotide
  misc_feature (1111)..(1111): n = any nucleotide
  misc_feature (1116)..(1147): n = any nucleotide
  misc_feature (1196)..(1196): n = any nucleotide
  misc_feature (1257)..(1257): n = any nucleotide
tatgaagacncagacatcttggaatataatgagaagtggccaaacatgtttagcaaatacaggaggagagcatcagttgcagtgttttgcatgtttgaacaaaaagataatatgctcagaaaaattgactatataaaagtaaggatatcatgaatcacaaaattgtcgcaagaagtcctcagaccaccaataaggaaaattcagcaaaaaataatagcacagtacaccgagtccttaacactactataaagcatcctacgacgcctcagctctctgtgttttcaataagtattgctttggtgggcttcgcaagcaagtccgtgtactcctggaagggagatttgctgaaacgagtctccatccagaaatctggtgtcaggaatccgtaggtcttcatgagacactcaaaggtggccttgacaaagtttccaagagtcttggtcgaaccacgagacgaggtgaagacgtcctcaatcccagcaaattggagaaccttctttggcacacgagcggccacgatccccgcacccctcggcgccggtaccattcgggacggtgaccgacccgcacttgccggtgaccttgcagggcacagtgtggggcttcccaatcttgttcccccagtaccccctcctgacggggattaccgagagcttggccaggatgatggcgccgcggattgcggtggcgacctccttggcgcacttgacgccgaggccgacgtggccatcagtgtcgccgacgacgacgaagccttgaacgggtgcgctggccggcncgggtctgcttctggacagcatgatcttcatgacntcatcnttaaggcngccaccgaggagggtntcgatgatctggtgttccttcacggggnagggagtgtaggtagatctgctcgangctggtgatctttccctccttgacgaggcgaccgagcttggtgacgggcacccacttctcctcctcctcgcgtcggccgccgcgacgcccacggcctcggtcgccacggccacggccacggtcacctcgaccgcggccaaacccacgcccaaagccaccacgatctccgccgcgctctgccatgaagatgaaagagttggaagagacgaggcgncgtcnnnnnnnnnnnnnnnnnnnnnnnnnnnnnnnnttgaatgaagcttaggatgatgatgcatgccttctttcagtttgctttngctttattttttgacaaggtaacgagttaatttacttaagtgtattaatttagaggtcttntggttggt

SEQ ID NO: 5215 - DNA, 640 bp, Musa acuminata
  misc_feature (141)..(141): n = any nucleotide
  misc_feature (339)..(367): n = any nucleotide
  misc_feature (623)..(623): n = any nucleotide
taatggctcaaccaaaagtttaagactctaacattaccatgtcactggcgacatgaggaaacatgcaaacaacaaacaatcaaatgtgaagtaaacatggcaacgtttctcacatcgtttgatactaatcaccacagcgcnaaaaatgagcacatcagtccgacgacgacgagccaagcttattacttaccactcacgacaagcaaccactactgcataacaaggccaccggccacggcaacgaaggagaagacagcaagaacaagggcaaacgcctgtggtacgggcttcgtgccagcgctgggccgcggggcagctgccggtgcagggatgcctccnnnnnnnnnnnnnnnnnnnnnnnnnnnnncgctgcttgtcgaaggggcaggagccggggaggtggaaggggcagcagaggaggacttggggatgttgatgtccaccttctggccgatggtgcagtggccggggaagccgcagaggaagtagtggtggcctttggtcttgatggtgatggagtcattaccggtggcgtatgtggcgatcggagatgaggcgttgcatgcattgtactcggccttggtcacctcaagcacgttgtggaagctattgttgtactcgancacgatggtgtctccat

SEQ ID NO: 5216 - DNA, 618 bp, Musa acuminata
  misc_feature (6)..(6): n = any nucleotide
attgtnaaggtctatattgatacaatgcacagtagaatggtcatacacaatgatcgaacttgtatacatcacagcaagaatggaattttatccatgtcttgtggaaataccacgcacacatcaatcattatactaactgtgggttaaatgcccatatatgattagccaatgatgcttctctccattcctataatgatcagaaagcacagcttgatgatgtcagttgtcgtcgatcaatttgtttacgatttctgattgccatgcaccaccagcaaatctgttgattaattgagccgcgatagctaccacagaccccagggcagcaccagcgatgacctgaataggagtatggccaagaagttcatgtagtggtctagtaacagacagaggatgctcttctggaagttcatacataatttgatttaacacctctgcctgctttccagcatgcagtcgaacaccaaaagcatcacacatcaccacaaatgctaatatcgccgctgtagcaaaagcagaactgtccaacccatcttgaattccaatagctagtgctagtgcagtcactgtggctgaatggggatgatgggcatcccaccagatccaataagctcggaccgc

SEQ ID NO: 5217 - DNA, 562 bp, Musa acuminata
  misc_feature (10)..(10): n = any nucleotide
  misc_feature (37)..(37): n = any nucleotide
  misc_feature (396)..(396): n = any nucleotide
  misc_feature (534)..(534): n = any nucleotide
cctccatttntgctgcttgaacaaatacctcatcaantttgggcactcattgtgctacatttatcacatacataacacattcccaacataaagtacattaaagatcacgatcaactaatacaagtataaataaatagtctgtcacggtgatgagaactcaaacaatctccgtaattgcttctcccccaaaccaacacagccttatcgaagcaaaggaggggttcatatctctgaaggaacgcgcaggtacaggtgggacggcaacctcggcgtggccacaacccgcaagggagtctgcatgaaggtgaccatccccggagtctccgtcatgtcgacgtcctccggcttgacaccgtccggcagagtccagctgaagtggtgcagcaggtggccgancatggaaggtgaccaggttgatgccaagctgcgccccggggcagacccggcggccggtgccgaacggcagcacccggaagtcgtgtcccttgatgtcgatgtcctcttccaggaaccgctcgggccggtactcgagcnggtttttccacgtcttggggtcacgggc

SEQ ID NO: 5218 - DNA, 555 bp, Musa acuminata
  misc_feature (10)..(10): n = any nucleotide
  misc_feature (29)..(29): n = any nucleotide
atagcatgcnactaataattactagagtnacacgagataaaagtaagttaaacatttgattaagacgacaaggcatgcggcttccaatgcatcataatgcgtaaagaagatttggcagaaggtttatctgatcacataaaagaaaaaactaaaagagaacagacacaaaccaggcttgattccagcaggggggatcatcatttcttcttttcactcactccagcagacctcatcttccggagaacattagccatctcctctctcttctttttggctctcttgtgtgtacccagctttctcttagcaactttcagtgcacgcttgtcctttccaactttcaacagctccgtaatcctcttctcataaggtgcaaacccagccacttccctgatcaagttcctaacaaaatgcaccctcttgctagttttcccttttctgctggaaggacgagggggcaactccctcctggtgacgatgtgccccttgttgagcccaacaaagagaccggtgttcggctgaggaggggcatctcaaagcccggcgagaaaacaccgt

SEQ ID NO: 5219 - DNA, 576 bp, Musa acuminata
  misc_feature (11)..(11): n = any nucleotide
  misc_feature (476)..(476): n = any nucleotide
  misc_feature (527)..(527): n = any nucleotide
  misc_feature (533)..(533): n = any nucleotide
accttcttatntacactgtcaaaggtactacagatacagttggttatgatttttgtgcagagagtacagagaggaagtgaacattatgtccttgttgctcctgtaaacctagaagggcccagacgtgccctggtatatgctatgggcaatgaagccagtttctttgcttttcctacaatgcacgcctcgtgaagttgttgtagtcattttcttcaatggcgtcaaggatctgtcgatatagcagcagagaagccaaaaccggccatctgctagctgaattcagctcgtatatgcccttctcagcctcctcaaagaacatcctggctcgcctaatctgtcccttcatgaagctcctccattcgtctgtcactcttcctttgaagatgtcatcatctgatagaccagcttgtgccaattcatcctgcggaaggtagattctccccctcctagatcttctccaacatcccttagtatgntggtagctgattggcaatgccaagagccaaggctgtttgtagacgctctcngtcgangccttcgaatctggggcatccccatcactggcaaatcatcagc

SEQ ID NO: 5220 - DNA, 568 bp, Musa acuminata
  misc_feature (11)..(11): n = any nucleotide
  misc_feature (31)..(31): n = any nucleotide
  misc_feature (38)..(38): n = any nucleotide
  misc_feature (86)..(86): n = any nucleotide
  misc_feature (94)..(94): n = any nucleotide
  misc_feature (119)..(119): n = any nucleotide
  misc_feature (190)..(190): n = any nucleotide
  misc_feature (258)..(258): n = any nucleotide
  misc_feature (266)..(266): n = any nucleotide
  misc_feature (297)..(297): n = any nucleotide
  misc_feature (327)..(327): n = any nucleotide
  misc_feature (410)..(410): n = any nucleotide
  misc_feature (434)..(435): n = any nucleotide
  misc_feature (441)..(441): n = any nucleotide
  misc_feature (448)..(448): n = any nucleotide
  misc_feature (450)..(450): n = any nucleotide
  misc_feature (453)..(453): n = any nucleotide
  misc_feature (478)..(478): n = any nucleotide
  misc_feature (486)..(486): n = any nucleotide
  misc_feature (488)..(488): n = any nucleotide
  misc_feature (493)..(493): n = any nucleotide
  misc_feature (535)..(535): n = any nucleotide
ggattagcatntgtctaactgaaagtatcancaataanaaaatgcaacatactcaatcgtgtcccaaaactaaatagaatacagangcagtagnatctgaattcataagactcgtgtcncttacggatgatcaatagaagagcggtgtgaatgaagaagggccagctcgtcctactgggggtgctgctgntattgcaatgctgattggaccaaatgctccaatttcttttgaaagtaaattcagaggaactcatatgnctcatgtntatgatttttataagccaaatctcgcaagtnaatacccggttgttgatggaaagctatcanagacatgctacctcatggctcttgattcttgttataaacgtttttgcagcaaatttgaaaagtttgagggaaagcaattctcnatttctgatgcggattattttgtnntccatnctccctntnacnagcttgtgcagaaaagtttgctcgnctctattntnaccgnttcttgcgcattcaagtgttgtcgagaggatgcaagggaaangctggagcagttctctaatctgactggtgatga

SEQ ID NO: 5221 - DNA, 562 bp, Musa acuminata
  misc_feature (18)..(18): n = any nucleotide
  misc_feature (22)..(22): n = any nucleotide
  misc_feature (36)..(36): n = any nucleotide
tgcctctgaaagcttagnttanaacatcaaaccttnatgaccctgccttttcatacactgtgcatcagttcccaaagatggacgactaccaacaaagtaaacaatgaaggagccaaaaaaaagaaaagctagtaaatcgaaacgaatcatgcaccacacgaagcatggtcaacatgcccgaagcaagactggacctacacgtgtgctaagcatatcacttagcgccaactgtacctcgcttgagccatgctcgcagcttattagacctgcaaggagggggaagaaccgagccaggttcttttccaaagaggtatcacccaatccggatatagcttgcagggtggacacaacaacgggtgcccgcgctgcgagttctcgccgtttcgcagaaccaactgggataagccagtgacttattggttgagcaccagtcgaagcttcaccagactgccccgtcgctgttctaatatacacctccagcacctcgttacagaggtcaaccaggcttgcttccgcttctaagttgctattacggtgccggtctgtgacaatgttttgaagc

SEQ ID NO: 5222 - DNA, 539 bp, Musa acuminata
  misc_feature (8)..(8): n = any nucleotide
  misc_feature (13)..(13): n = any nucleotide
  misc_feature (16)..(17): n = any nucleotide
  misc_feature (21)..(21): n = any nucleotide
  misc_feature (25)..(25): n = any nucleotide
  misc_feature (42)..(42): n = any nucleotide
  misc_feature (45)..(45): n = any nucleotide
  misc_feature (49)..(49): n = any nucleotide
  misc_feature (51)..(51): n = any nucleotide
  misc_feature (59)..(59): n = any nucleotide
tctttttnatcanatnntgtncaanatgcaaagcattcagantgntgtnantgcttggntacagcacggtgtatatggtagtagaaataccagttgatacactcatccaatacaattaccaactccaccttggatgcatgtgttgaagtaataggttccctcgtggctcgatcccaccaaattaagctgaagcaatcagttgttggggtccaaatcaaagtctttcaaaccttatattaagttacatacttctacattaattacgctcattgaagagctcaatggagagcctcgtttcggaagctgccgagacatgcgaacgcttcaaaatgacggcacgacgccatagtcgtcctccgccatgagggccgccaccgcctccgcggccgatgagtagatccggccgacttccgcctctacctccaccctcttcgcgaaccgccctttgatccttggccgcgctccgcgtaggccttcctcgacgcgtaccttatcgtcttctcgaacctccggcacttccgcttctccggtactcatca

SEQ ID NO: 5223 - DNA, 429 bp, Musa acuminata
ttaatttaacatggaatgaaatagagacatgctgatacagaaacagtgcgatctatagagcaatctatagtggtgtggcggtgaccggatgctacgttatgtgggttgaactcatctgcttgcatgcttccttcgtccaatccaaatccgtcgtcgtcatcgctatctacatcctgattcttccgaggaggcagccattagctgggagctgcgaacccgccacccttcatcatctgcttgaactccttaaagttgacgacgccgtcaccgtccacgtccacctcgttgatcatcttccggcagtcctcggcggtgcggccttgcttgaggccgagggaggcgagcacggagcgcagtcttccacggtgatgaacccgtcgccgttgcggtcgaacacgttgaaggcctcgcgcatgtcctcctcctcgt

SEQ ID NO: 5224 - DNA, 498 bp, Musa acuminata
  misc_feature (432)..(432): n = any nucleotide
  misc_feature (436)..(436): n = any nucleotide
  misc_feature (438)..(439): n = any nucleotide
  misc_feature (445)..(445): n = any nucleotide
  misc_feature (447)..(447): n = any nucleotide
  misc_feature (449)..(449): n = any nucleotide
  misc_feature (456)..(456): n = any nucleotide
  misc_feature (458)..(458): n = any nucleotide
  misc_feature (461)..(461): n = any nucleotide
  misc_feature (477)..(477): n = any nucleotide
cttgcaatgaataatagaagaggatggttcataatttaaaatgggtctgaagaaattctcgttgacatcggccaactaataaccaaaccattcgatatgtgtaccaaactatttctggaacaaatatgatgcaatctaaaacaacatctgttgctcatctcaagcaccattaagtcgttacacgatagcatttgctgcactagcaattcttggccacagatcggcacattccttcccgatgggtcccgtgatagcagatcctttcatttctcccttcggattaacaatgactccagcattatcttcgaagtacatatagacgccgtcctttcggcgccagggcttgcgctggcggacgatgacagcgggcatgaccttcttccggagatcaggcttccccttcttgacggtggccatgaccatgtctccgangcangnngaaggnangnggttgangnggnccttgatccccttganggagatgatgtagaggttctt

SEQ ID NO: 5225 - DNA, 485 bp, Musa acuminata
tcgtcgtcggtgggccacggtcgtggagacgcgattgggcgagggagggtgcagctgaagcggatcgagaacaagatcaaccggcaggtgaccttctccaagcgccgatcggggctgctcaagaaggcccacgagatctccgtcctctgcgacgccgaggttgccctcatcgtcttctccaccaagggcaagctctatgagtactccaccgactccagtatggaaaagattcttgaacgttacgagtattactcctacgcagaaaaggctcttatgtcatccgatcaagattatcagggcaactggtgtcaagaatatggaaaacttaaggctaaggttgaagctttaagtaaaagtcaaaggcatctaatgggagaacaacttgaggccttgaatcttaaagaactccagcaactggagcatcagcttgaaatttctctgaagcatattaggtcaagaaagaaccaagtcatgtttgactccat

SEQ ID NO: 5226 - DNA, 499 bp, Musa acuminata
  misc_feature (12)..(12): n = any nucleotide
  misc_feature (86)..(86): n = any nucleotide
tggaggaggagntggagatggggaggggaagggtggagctgaagcggatcgagaacaagatcaaccggcaggtgacctttgcgaangcaggaatggactgctcaagaaggcctacgagctgtcggtgctctgcgacgccgaggttgccctcatcgtcttctccaaccgcgggaagctctacgagttctgcagcagctccagtatgttgaggacactagagaggtaccaaaagtgcaattatggtgcaccagaaacaaatatcatatcaagggagactcagagtagtcagcaagagtatttgaagcttaaggcgcgtgttgatggcttgcagcgatcacaaagaaatctgctgggtgaagatctggggccacttaacatcaaggaacttgagcagcttgagcgccaacttgatgcatcgttaagacaaataagatcaacaaggacacaatacatgcttgaccagcttggagatctccaaagacgggaacaaatgctatgt

SEQ ID NO: 5227 - DNA, 563 bp, Musa acuminata
  misc_feature (15)..(15): n = any nucleotide
  misc_feature (92)..(92): n = any nucleotide
  misc_feature (473)..(473): n = any nucleotide
  misc_feature (541)..(541): n = any nucleotide
  misc_feature (552)..(552): n = any nucleotide
aaacatatactaatntgtaaagtacatgtttactatgtttagcatgtttagcctggtttttctatgataaattcatagtacaacaacacgantcaaatgtctacaagatcagcagactgtttggttcccaataatgaagtttagttctgaagttgaagacatcatgagcaccaaactctcttttggtgatttcttcggttatgcattgcatctcccaggtacatcaatcttcatgttcgtcttcaccttcagaatctgatctaatatcttcgccgagttgccctgattggatttgtttcacaagcattcggaacattaatatccaccaatagatatgtaaaacaagcagtgagaataggagagtgttgaagacataataatatattggtccttcaaacttgtgtttttctttgtccaaattcaagagaacttcatagcttgtacttcgaaggatccagaaaggaaaatatgtnagacgaagtattatccatgaaaacaacatataggagaaaatgctacattaggcaaggcatctcataancgccatacttngacatctttgc

SEQ ID NO: 5228 - DNA, 865 bp, Musa acuminata
  misc_feature (401)..(401): n = any nucleotide
  misc_feature (855)..(855): n = any nucleotide
atcttctcacatcagcgaattccacgatcttcttctttgtcatgcaaagacagacagcagaggcagtcattcctcgttgtcattttattggatggtaagatagcattacagcatcacgaactgagcatgcaagcaagcttatttatatagatcgatgtatttatatatgcttgcacgagatggtgtggaagagaggcaacagatcagtcgccgcagttgacgaactggtagttgacaatcaagtggcctcgattgtagccgccaccatcggtatccagttgagagaagacgccttggtctaaatctaaccctccgttggcgcactggtccacgatcctgaccgtagcctgagttcccgtcgccgtgttcgtcacccgcaagcacttgccacccacgcgtcngggatgagttacgggatgctgtcttgcttgtgtttgcgaacaaacaagaccttccaaatgcaatgaatgctgctgaaatcactgataagcttggtctgcattccttgcgtcagcgacactggtacatacagagcacttgtgctacatctggtgagggcttgtacgagggacttgattggctctccagcaacatagccagcaagtgaccaaagttgctcaacggccctcaacagcagacaaaatttggcatttcagtgttggatgctttggtgaatcgttaccaagacaacaaaatttgaaggttccactggttaccaaaactttaaagatatcggctgcctcagaccttttatgctttttatctatctactcctttttctggatatatctaggatgatgatactcttgtcatatatttctcacaccactgggtgcccattatgtcatctgatanttcttactta

SEQ ID NO: 5229 - DNA, 599 bp, Musa acuminata
cacggccatgcaattttccttccagaattctgtcatcaaggcgaaaattcactactttgttgattaaaagatgatacaacaaaattaaatacagaagcagaaccttacaaatcgtgagtcacattcgtgttcaaaaattctctcaactcttccaagactatgcatggttgccaacctcagatttcagtccttagctctccccaagagtgaagcgaacaaacctcctaactttgatgttctctccgagggcagcaactgtctgcttcaccagatccttcaccttaatgctatcatctttgatgaagggttgctccagaagagcaagctctcctagcctctttgtgatccttccttcaacaatcttctcctttatttgatcgggtttcgacttgagatcctctctctgcatttctatatctttttcctttgtgacaatactctctgggatgtcctcgatggagacgaactcaacctgtgggcaggccactacctgcatagcaaggtcatcaaccaattccttgaacttttcgctccgccccacaaaatcagtttcacagttgacttcaatgagtgtgccgatgcgggagtcatggatgtag

SEQ ID NO: 5230 - DNA, 519 bp, Zea mays
atggcgtccaactacgtggacacgacgggcgaggagggacggttccacggccctcacagccacagcaccagcacgaccccgacgggcggcgcggcggcggcggcggcatcgccgcgcaacttccggcgcagcttctcctccgcgtcctccgcgggccacagccacggcggcggcggcgccgtattcaaacgttcgccccctccctgcttccgatcactgtcctgctccacaaccgttgtttcctgcgttgtgttcgttcacccctcccccccactactccgcccccgcccgccatcccccctgttacctacacacacctcattatccaggagtgaagatgttgacgccacaccacataacgccgacacctgtctcactccccgcgccagcatacccatagcattccccccctatctcatctcgcccatcgcctcctctccacccggactagtatcctggctcgcgccctgtcgcgattcagacccgccttatatactctatattcttttccgtgactta

SEQ ID NO: 5231 - DNA, 672 bp, Zea mays
atgtactcaactgacagtgtatttttgatctttaaaattagagatgctctcattcccctgctggtggtggcagaagcggcccgagtacactttcgcgtgcatgttcctggacatgctgacggggaagtccccggcgcccgcggtgctgcacgacgaggtcgtggacctcccgcgctgggcgcgttccgtggtgaaggaggagtggacgtccgaggtgttcgacacggagctgctcaggcacccgggcgccgaggacgagatggtggagatgctgcggctggccatggactgcaccgagcccgctccggaccagcggccggccatgcccgagatcgtggcgcgcatcgaggggctcggcggcacggcgtcgacgtcgacggcgacggcgcggtccggccggagtgcgtccgtggacgaggcggacgaccggccgctgaggaccaccggatcgatccgtcagagctgaggtccgtccgcgtccgatcacttgtgttattgtcactgacggaaggttctgaacaagggggaaaaaaagaagagatctttctgttctgtcttcttgcgcttgtcgtaggggcgttgtcgtgtgctgtttattctttcatgcgtctcttgacgcttgttcgccctcagatgaattctttcgttttagcagcggtgatgagtgtgcgc

SEQ ID NO: 5232 - DNA, 537 bp, Zea mays
atgacgatacaagttgttcaggacaacagcaggatctgcacttcttttcagctcaattactacacgcattccagtgcggtcactttcatccctaatatcacttataccttccaataccttatcttcaacaagctcagctatcttttgtacaagagtagctttgttagtttggtatggaatctctttaataataatagctgtgcgcttgcttttctcgtcaattgtttcgatgccagactttcccctcacaaccatgcggccacgtccagatttatatgcttccaaaataaccttgatttcccagcattgtccctcctggtacggaagtcaggcaccaggcatgcgcttctagtatttcttggaaccgcaacttccccggctttccacataacttaccgaaagccccttcaactagcctctccccagattatgaggaaggaatattctgtctgccttttcaaccccgaatcccagaaacaaccatttcaccacaaaaaaggagactcccgcactggcacgagaaaggcctcccttctg

SEQ ID NO: 5233 - DNA, 516 bp, Zea mays
atggaggccctgaacagtgataagagtactaccttagaaactgagaccttgaatgaacagaagaaccagctgactgacaagcttgaggcaaacaaagatgagcttgagaaaactaagaaggcaatggagggtctggcctcagccttacaggaaatgtcagctgaatccagagaggcgcaagagaagtaccttctcaaacaagatgagattgagcgtgctcaggcacaggtagaggagcttagcttgagtctgaagaatactaaggagaactatgagctattgcttgatgaggcaaactatgagaaggtttgccttacgaaaacagttgaaagactgaaagcagaagcaaagagtgcacatgaggaatggcattccaaagagctaagttttgtcaattctattaagaattcagaggaagagatagttgctatcagagttcagatgatcaggaccttggaggttgttatagagaaagaacgtgacaacactgagttgcaggagaagctgcagcagctt

SEQ ID NO: 5234 - DNA, 270 bp, Zea mays
atgacgcccgatcacccatcgcggaggccgcagcgagcgcggggcagcgcgacgacgacctcctccgcaccgccacaccttcctcgcttgaggccatcgacgccaagctcaggtcgctggatctcaagtaccagagacctaccgccgccaagctctacctccacgtcggcggggcctcgccttccgcgcgctgggtgcccgccgagcgccgcgcgacctacgcattcgtcgaccagtcgagcgacgacgcctcctcccccaggtggttcc

SEQ ID NO: 5235 - DNA, 720 bp, Zea mays
atggttgctatggcggcgccagggcgagtggcgctcctggccgccgcactcctgttcggcgccttcttcccatccgcgttcgccacgtccttgtaccccgcaaggcttgcgggcaggctcctgtccaccacggcgtcggcggtggccaagcagctgtggtcgctcaaatcggccgccaccaagacggcgacggcgtccgtggcggggcggtccatggtgcggtacgagggcgggtacgcggtggacacggtgttcgacggcagcaagctggggatcgagccgcacgccgcccagatcaaccgcgccggcgacctcctcctgctcgactccatcaacagcaacatctacagggtccagctgccgttgtcaccatatagcagaccaaagctccttgctggttctccagaaggtttatctggccatgttgatggaagactgcgagaagcgaggatgaaccatcctaaggggttccctgtggatgataggggcaacatttatgttgcagatgctatgaacatggcaataagaaagatcagtgacacagggggtaccaacattgctggggggaaaacaattaaaggagggtaccagaatgagcccagtggcagcgatgatgcagatgtcccccccattcatgacgtccaaaacttcagtttttactgcacccctcttgaccttgaaataacgaaaccacgaatttccacaattttccctgaacta

SEQ ID NO: 5236 - DNA, 624 bp, Zea mays
  misc_feature (13)..(13): n = any nucleotide
atgctgcactccntagaggagtctcagctgatgcgagagaagcttgccgagcagcatagggacttgctgcaggcaaaggatgaagccatgagggcaggggacgctaggaattccttccagactgcaatgtacgatggaatgcgaaggccaatgcactcaatccttggtctcgtctcaatgatgcaacaggagagcatgaatccagagcaaaggcttgtgatggatgccattgccaagacaagcagtgttgcatccacactgatgaacgatgtgatgcaaacatcgacaatgaactgtgagcacttgtctttggtcaggaggccgttcaaccttcattccttcattaaagaagttgttggagtggtcagatgtctaactggttgcaagggtgtggagtttgagtttcaagtggagaattctttgccagaaaggatcattggtgatgagaagagagtcttccatattgtcctgcacatggtaggcactctaacagaccgatgtaatgctggctgtatctcattatatgtaaatggtcataatgaggttgaagataggcataatcatgactggatgctgcgaagagcaaacttctcgggggggctatgtatgtgtgaaatttgcgat

SEQ ID NO: 5237 - DNA, 732 bp, Zea mays
  misc_feature (732)..(732): n = any nucleotide
atggacacgggcaagtacgtgcggtacacgccggagcaggtggaggcgctggagcgggtgtacgccgagtgccccaagcccagctccgcgcgcaggcagcagctgctacgcgagtgccccatcctctcaaacatcgaggccaagcagattaaagtctggttccagaaccggaggtgccgtgacaagcaacgcaatgagtcttcgaggctccagtccgtgaacagaaagttgactgcaatgaacaagcttctcatggaggagaatgagcgattgcagaagcaggtttcccagctggttcacgagaatgcgtacatgaagcagcagctgcagaatccgtcactggcaactgatgcgagctgtgagtcaaatgcgaccactcctgcaaacctaagggatgcgagtaacccatcagggctccttgcaattgcagaggagaccttgacagagttcctctcaaaggctacagggactgctattgattgggtccagatgcctgggatgaagcctggtccggattcttttggtattgtgaccatttcacatggtggccgtggtgtcgctgcccgtgcctgtggtctggtgaacctagaaccaccaaagatagtggaaatcttgaaagatcgtccatcttggtttcgtgattgtcggagtcttgaagtctatacaatgttaccagctggaaatggtggaaccattgaacttgttacatgcagatgtatgctcctactactn

SEQ ID NO: 5238 - DNA, 507 bp, Zea mays
  misc_feature (451)..(451): n = any nucleotide
atggctgagaagaagatggttacgctcaggagctccgaccacgaggagttcgaggttgaggaggcggtggcgatgaagtcagagatcatccgtctcttgatcgaggacgactgcgccgacaacgccatcccgcttcccaacgtggattccaagactctcgccctggtcatcgagtactgcaacaagcacgtccacgtcgccgccgacgactccgccgccgcggagaccagcaacgcttcatcagctgggggcggcggcgaggtcgacctcaagaagtgggacgcggagttcgtcaaggtcgagcaggcgacgctcttcgacctcatcctggctgccaactatctcgacatcaaggggttgctggacctgacctgccagacggtggccgacatgatgaagggcaagtcaccggaggagatccgcaggacattcaacatcaagaacgacttcnaccgaagaggaggaggaggagatccgcagggagaactcctgggccttcgactgatg

SEQ ID NO: 5239 - DNA, 411 bp, Zea mays
atggccatgcccaacccaagaacggtgttgacatccgcgccgtcaccgcccggctcctcctcctcctcctcctcctcctcctcctggtcggcggcggagttcatggcgccagcgcctccgtcgccctccgacggggagctgctgcgctcgctgcaccgcctggcgcgggacctgtccgctgcggccgagacgccggccccgttcctgcgcggcgcgctcgcgtccatcaccaggcgttccaagctcctggccgcggcgttcgacgacctggtcccgtgcgccgcggccgaggacatgccgcggcccgcgacgctgtgcctgcgcgaggtgctcctcgtgctgcagcgcttcaaagacctggccgccgactgcaccgcgcgaaaccggatgcgactgctgctgcgcttggac

SEQ ID NO: 5240 - DNA, 612 bp, Zea mays
  misc_feature (63)..(63): n = any nucleotide
  misc_feature (70)..(70): n = any nucleotide
  misc_feature (86)..(86): n = any nucleotide
  misc_feature (101)..(101): n = any nucleotide
  misc_feature (113)..(113): n = any nucleotide
atgccatttgagaaggcagctacactgggaaaaatcaaaattgtattggatgttgcgcatctngagtccnttacaaaggatggganctatgatctaaactntaagaatcagcntaatgatggagcccatattctctcagcccagcatctgggtgatctgtacagagattttgtcaaggatttccctattgtatcaattgaggacccttttgatcaggatgactggagttcatgggcatcattgcagtcctcagttgatatccaaattgtgggtgatgatttactcgtcacaaacccaaaacgtatagcagatgctattgacaagaaggcttgcaatgctctgttgctaaaggtcaaccagattggtactgtcactgaatcaattgaagctgctctcgattcaaaagctgctggttggggtgtgatggtcagccacagaagtggtgaaaccgaagacaacttcatcgcagatttggctattggcttagcaagtgggcagattaaaaccggggctccatgccgcagcgagaggctggccaaatacaatcagcttctgcggattgaagaggagcttggtaacgtgcgctatgcaggggaggcattcaggtctcca

SEQ ID NO: 5241 - DNA, 336 bp, Zea mays
atggccgcggacgccaccgcctccgcctcctcctcgtccgccgcatacctcccgacctcgcgcctggacatccaggccgccgtcgccaaggccgccgagctgcgcgcgctccacgccgcgctcctccagggcggcagcagcagcggtggcgccgtcgccgccccgtccaatgtcgggggctacgccagcgctagacggagcctcgccgtcatccgcctgccgccggccgcgtcgtcggagccggcccccctggccacggccgccgaggactaccccgtgattgcgccgacttatgatgaagagcacttgtgttggaacgatctactttccccaaga

SEQ ID NO: 5242 - DNA, 537 bp, Zea mays
  misc_feature (75)..(75): n = any nucleotide
  misc_feature (113)..(113): n = any nucleotide
atggagaccgcaccgttcagaccgggaagctccggcaacggcgctccgctgcccatgtccagggccggggccgtnccggcggcggcggcgcgtccgcccgtggggcagctgcntaagtcgatcctgaagaagagcaccgatgaaggaaactctgggaccgccagggaggtatctcgtgtgacgttcatgctggacggcggcgcaccaatggtggtcaaggccgccaaatccgtgggtttcgcttcttcccagccacccccgcgcccgctgttgcagcagcccatgcggccgaaccagcctcgccccagcggcttccccggtggacagcagcaggtggggtacccacctcggtccggcgacagcccgccgcagcagttcccgcctcgtccgagcggcggcgccgagattccagcgtggaagatgggggagagggagttcaaggaggaggtgtggaggctgatgacggggatcgccaagctggtggagccgctgaccgacaagaacggcttcttcccctaccacctgttccgagcacag

SEQ ID NO: 5243 - DNA, 345 bp, Zea mays
atggcagcaccaaaagcagagtttgcggatggctacttggatgctgctataatcaaggactgcccgcggtgggatgttctggggctcgtgctccagatgaaggacggcgcctacgtgaactcgccgtgcgtggagtatttcaaggtgaaggcgatccggatcgagccgggcctgcgcgtgggcagcagcaccaagggcggtatcatcgactcggacggggaggtgctcgcgaggggcgacgggtcccactcccgcgccggcgacgagccggggcacctgatggcgtacggcccgcccatccagctgacggtggaccaggggctggccaccatcttctccccgaga

SEQ ID NO: 5244 - DNA, 564 bp, Zea mays
atgcaggctgcatctggtactaaaggtggctcaagtggttctcctgttgttgattgtcaaggaagggctgttgccctgaatgctggaagcaaatcttccagtgcctctgccttcttccttccattagaacgtgttgtcagagcattggatttgatacgtgacagttgggatgcatttggtaccaagacagaatctgtttatattccacgtggtacacttcaggcaacctttcaacacaaaggatttgaagaaactcgacgtcttggcctccggaatgaaacggagcagatggtgcgtgtagtttctccagaaggcgagactggaatgctggttgtcgattcagtggtacctgaaggccctgcacataaacatttagaacctggtgatgttctagtacgcatcaatgaggaggttgtaactcagtttcttagattggagactttacttgatgatagtgttggcaaggaaattgatttgcagatagagaggggtggagttcctttaactgtaaacctgcaggttgaggatttgcactctataactccaaatcatttttttggaagt

SEQ ID NO: 5245 - DNA, 489 bp, Zea mays
  misc_feature (488)..(488): n = any nucleotide
atgaacttgttcgcgggggtcggcggcggggcggcggacggtggcggcacaggcacggcgctcctggagctgacgccgcacaagatggcggtgtgccacctcgtgcaggtctttgcgccggcggcgcaggccgggggcgacgtcgtgccgcccttccccttcgagtccctcactcaccacaaccgcctcggactcttcctgtttacgctcacccggtcatgcgatgattttctggagcctccactggaagaatttttgaagcagctgagggcagtggatgatttgactaatggttggttctgcgagcagctgacaagtgccctgtcagcactcaactcacctgatgacttgttcaacttctttgataagctacgaggtgtgttcactgcaccagagggtgcgagtgcagaagatgtattcttggatccaaatagccaacttggagtatttcttcgttgctgcatacttgccttcaactcaatgacctnt

SEQ ID NO: 5246 - DNA, 525 bp, Zea mays
atgatgcgatgcatggactacggccacaaggttgtcgctttggctaatcttatccccctcgacgacaccgtcgatgagctcgacagctacatgtaccaaactgttgggcaccagattgtggtgagctacgcgaaatgcatgggcttgcctcttttccggaggcgcattcgcggatccacaagggatcagggtctcaggtacagtgtcacggcaggtgatgaggtagaagatatgtttgctctgttgagcgaggttaaacgtcgaatcccatccatcagcgcggtgtcgtcaggtgcaatcgcatccgattaccagaggctccgggttgagagtgtttgctcgaggctgggcctggtctcgctggcgtatctatggaagcaggatcagactttgctcctagaggaaatgataaggaggggcattgtggcaataattgtgaaggttgctgcactggggctgaaaccttcttcccacttaggaattatggaatcaatgtctgtggtgaaggtggagaatatgaaacac

SEQ ID NO: 5247 - DNA, 288 bp, Zea mays
atgagatttaagagaaaaaaaacttcgcagttcacaagtgattactcaatgcagctcaatgcttctagaattaaagtccttcaagctcaggatgatttggtaacagatatgttgaagtcagcaagcaaagagctactgcgcataagtagagatcacctcacttacaagaagcttctcaagacacttattgttcagagtttgctgcgcctgaaagaaccagctgtgcttctgcgctgcaggaaggaggatctccaccttgttgatttagttttggggtctgcaaggaaa

SEQ ID NO: 5248 - DNA, 504 bp, Zea mays
atgcccgggggtttgtggagtcccggcgcgggggggcaggggggtggggctcgggcgggtgggcggacagagggtcggtttcggggcccgggcggttcgccgcaatctaggggggagaggtgtcgcgcgggccgggctggattggataggttgggcagcggattgggaggaaggctggtagggccccagggacaggggaagaagacagggattggaaaggaatcgaagggactcagggttcgaaccggtgggtgggggagaaacgtttggtgcggccgaccggccaggttcggaggatgggagaagcggggccctggccaggggacatttggtggcggtgctcgggcagcagtgggcggggggctggtcatgctcgaggggtgtcgacgatgtcttggcagggagttcagctcggccttggagattcaccacctactgctggagcgcgaaggatgtgggcgacgcagcggtagacgggggtcgcggagccgcacctgggcctcg

SEQ ID NO: 5249 - DNA, 705 bp, Zea mays
  misc_feature (594)..(594): n = any nucleotide
atggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagcttgaagcctcttgttccacgcttgtctgagctccttggagttgaagtcgtgatggccaatgattgcattggtgaggaagtcgagaagttggctgccgctttgccagaaggtggagttctgctcctagagaatgttagattctacaaggaggaagagaagaacgaacctgagtttgctaagaagcttgcatctgttgctgacctttatgtcaatgatgcttttggcacggcacacagagctcatgcttcaaccgaaggagttaccaagtatttgaaagctgctgttgctggcttcctcatgcagaaggaacttgactaccttgttggagctgttgccaaccaaagaagcatttgccgccattgttgntggatcaaggtcttcactaagattggggtcattgagtcgttgctgccgaaagtcgaatccgtatccttggtgggggatgatctaccattttacaggcacaggaaattttgg

SEQ ID NO: 5250 - DNA, 594 bp, Zea mays
atgggccgaactcagcgggcgggacaactgggacgggctcctggacccgctcgacggcgacctccggcgcgccgtcatccggtacggggagctggcgcaggcgacgtcggacgcgttcatcggcgacccggcgtcgccgtacgcgggcgcgtcgcggtacgcccccggcgcgttcctccgcagggcgcaggcgcccgacccggacgcgtacaacgtgacgaggttcctgtacgcgacgtcgagcgcgcgcgtccccggccagttcatcacgcggccggcgccgccgggggcgtggagcgccgagtccaactggatggggtacgtcgccgtggccacggacgccggcgtcgcgaggctggggaggcgggacatcgtggtggcgtggcgcgggaccaagcgcgccgtggagtgggccaacgacctggacatcacgctggtgccgccgaagggcgtcctcgggcctggacccgggaggccgcaaccggcggagcacccgagccatctggtccgggtaaccctctaagaaactcctcgctccggttcaccacgcacagagccagagaaaatttgtttggccaggattcaaaaggcctc

SEQ ID NO: 5251 - DNA, 492 bp, Zea mays
atgtatgagcagttccaaaacattctgaaaatgggtcctattggacaggtcttctctatgttgcctgggtttagcgccgaactaatgccaaaaggacatgagaaggaaagccaggctaagattaagcgctacatgacaatgatggattccatgactgatgcagagcttgacagcacaaatcctaagctgatgactgaatcacggatcattcggattgcacgggggtctggtcgtcctgtcagggatgtcatcgacatgctggaagagtataagcggcttgctaaaatctggggcaagatgaagggtctcaagatcccaaagaaaggggagatgagtgcactgtcccgcaacatgaatgttcagcacatgagcaaggtccttcctccgcagatgcttaaacagattggtggcatgggcggtctgcagtctctgatgaaacagatgggatcgaaggagatgagcggaatgtttggaggcatgggtggcgagcgg

SEQ ID NO: 5252 - DNA, 702 bp, Zea mays
atgatggttctgtgccccacacttcaaaagttgaaagagaagagggtgaattgtcgcctaacggagattttgaagaggaccattttgttcctttcgaagatggaacatctaaaggaaaggaagattctacaagcagaccattccatggtaggcctggggaagtggtaccctcttctgccgaggcagctggtgagaatgatgctgatgctgatgacgagggtgaggaaagtgctcagaggtctactgaggacagtgaaaatgcttcagaggcgggtgaagatgcatcgggtagtgaatctggtgatggtgaggaatgctctcgtgaagatcatgatgaggaagaagaggatatggatcacgatgatcaggatgcaaaagctgaaagtgagggtgaggcagaaggaacaactgaaacacatgatgtggaaggggggaatatcactaccactttcagaacgctttctgtactcagttaaaccacttgccaagcatgtacctacagctttacatgatcgagagttctcacgtgtattttatggaaacgattcattttatgtgttggtcagactacatcagattttatatgagagactactttcagcaagaactaattctttcactgctgaaaagaatggagggaatctaagggtacaaccctcgtggattatatgcaaagtttatgagcgcgctgttcaaactgct

SEQ ID NO: 5253 - DNA, 240 bp, Zea mays
atgacgttggggatggtgcggatgcggatgccggccggctcggcagcggcggcggcggaggaggagcggatgagtccgagccactcctcggtgacgacgaaggtgaccgccgcgccccgggctgcgaggaggcggctcaggttcatcatggcgttgacatggccgcggcccgggaacggcaccgctacaatgtggcagccgcagccgccggtcccgcccgcggcggcggccatccgcgcg

SEQ ID NO: 5254 - DNA, 669 bp, Zea mays
atggaccagggccacctcaaggacagcctcctcgtcccgtcctcccgcgccgccgcgacgaatgggccccaccaccgccgcgccacgctcgcgccgggaactggcgccggaggcccatgtggcggagccggcggcgtgtccatcgacgtcaacggcctgaagcggcgtggcggcgggaggcgctcgtgggtgcgcgtggacgcggcgacgggcgccgcggaggccgtcgaggtcgccaagccggcgttgatgcggcggctggacctgcccgcgcgggacctccgcctcctcgaccccctcttcgtctacccgtccgccatcctcggccgcgagcgcgccgtcgtctgcaacctcgagcacctgcggtgcatcatcaccgccgatgaggcgctcgttctgcgcgaacccgacgccgctgggggcgccgcagcggaggaggccgtgaggaggtacgtcgacgagctgcagcgacgcctcgtcgaccgcgccgacgacctgcctttcgagttcatcgcgctggaggtcgcgctggaggccgcttgctccttcctagactcgcaggctattgaattagaggctgaagcttacccagtactagatgagctgacagcaaaaattagtaccctcaacttggaaagagtccgacgcctaaaagcaagctggttgcat

SEQ ID NO: 5255 - DNA, 264 bp, Zea mays
atgggcaggtcagacggcggcgcctccagtgactgcagctccccgacgccgtcctccaccaggaacgccatggcgagaccccaggtgatgtgcacgtccaggtggcagtgcatgagccacaccccgggattatccgccacgaagcggatgaccgcccagccgttgaccggcacgcccaccgtgttcctcatgggcgggtcgtccatgttgaagctggcggtgtccgcggcggcgtcgaagttgccgaagccctcggcgaggatg

SEQ ID NO: 5256 - DNA, 231 bp, Zea mays
atgcttccccggtctcagctatcgggtttgagggctatgagaagcgccttgagatcacattctctgaggcacctgtctttgtggaccctcatgggcgtggtttgcgtgccctctccagggcccagattgactctgttctggatcttgcacggtgcacaattgtgtctgagctctccaacaaggatttcgactcatatgtcctttctgagtcaagcttgtttatctatcctc

SEQ ID NO: 5257 - DNA, 495 bp, Zea mays
  misc_feature (151)..(298): n = any nucleotide
atgcgcgtcttggtgcccggctgccggatctccgacacccacttgccccacttgcgcctccgcacgccccggtactgctgctgcggcgacggcggcggcgactgcggctgctggcaggcggcgctcgcacccacgcaagcggacgcgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaggttcgtatcgccttccggtgctccttcctatgacaggttaaatccccgtttctgcccgtcccccgccccatctggacgcttctacataagcttgcttctgtcttatataagagtttcccccccgtatcacgccccattcgtaccactcttggcactcactgccctgtcccctctggctattttaattttctgt

SEQ ID NO: 5258 - DNA, 336 bp, Zea mays
atggtgcatctatgcagtggtgagcagcagcaacagcatcttgctgaagcacaggagcagggcatcgtgtctttgctggaggagctagcagaaagtggcacggacagaggaaagaggaaagctgtgcagctgctcgaacgaatgaatcggttcctaaagcagcagagtcaagccgaagccgaagcagaggccatggcacaggctcatgcacaagcacaagcacaagcacaagcacaagcacaagcgcagcctcagatcctggttcaagctcaagcacatgcagatatgcaagctgaacgatcactacttcccacatcatctgacatttcggataga

SEQ ID NO: 5259 - DNA, 240 bp, Zea mays
atgaatcgaacaatccaggtgcatatggcagcagctctatttatggtgactcaacctggaggttcaactcatctgaggttgatatgcctccttttggtcatgatcttggaaatgatgatccagatatcaaatcagaaatatcagcaagctatatgggcaactatactgttaataacaatcagacaagcagaggtatcacttcctagggagagtactattatattcatatatgacttggga

SEQ ID NO: 5260 - DNA, 153 bp, Zea mays
atgtcccaggcaacaagcaaccagctcgccctgctccacagaaagctacagctgaagatgatgagcttgctgcactgcaagctgaaatggcactgtgatcaggtttccactgaagaggtgaaatgtgtatatgaattgcgttatgctgaaagc

SEQ ID NO: 5261 - DNA, 351 bp, Zea mays
atgtctggagggctcgcacaccttatcagagcccagttcacgccctcgaagaaaggatgctgctttatctcggtagcgccacgcttatacccaagtcggtgctgcgggtccttgactagcaatccccttatcatgtccctcgcagagaagctcactattggggactctgggaacctcaggggctggccaacaacgttgaagagtgtaccccggttgcctgaacctttgagtggagtcttcgcgaacaacagctcgtacaagaatatgccagaggtccaccaatccacaacacttccatgggcctctcctttttattccctcgtggggccaaaatacgcaggggcagcgaac

SEQ ID NO: 5262 - DNA, 417 bp, Zea mays
atgtgtgctgctaccacaactaccaaactctgcagctgcaatcatggcagctgccaacgcccgccgtcgcaactgaaacgctgcacctggatcactttacagcagcagcaacgtgttcgcgatcaggtctggtcatctggtttcttgtgtggaggcggccggcataccggcatggtgtgtgcttccagacggcgaaaaatggcgcgcatggttcggcgccgttcaactgcaaagggggacggtgcacgccaccgcctgcgcccagtaattgagccgcgccttcacctcgtcagggctgtcaccggggctggagatcttccagttggtgacaggcggggacggcgtggaggcatctggtggggaggactcgtgctgctgcggcttctcgtcgccagctgggagggctggctcatggag

SEQ ID NO: 5263 - DNA, 642 bp, Zea mays
  misc_feature (288)..(288): n = any nucleotide
  misc_feature (373)..(373): n = any nucleotide
atgcttcgtttcgtcgtctgccctgatcatttcggccttatgaggactgctatccttgtctgtagtatcctccttgggtttactctctcgacctgtggctgtggccttctgctcggctcccgtgccttggggagggtagtattgcggatcggcgaggaacgagagcgccgagacgacgtcgctgatccccggccggctggcagcgtcctcctgcaagcacatggacgcgacggcgagcgcctggaacagccccttcacggggtacctcttgcccagcaacgggtcggncagcttcatgaacctccgcctgtctctcagcagaggcgttgcccagtgaacgaggacctgctcctcggacggcctcgtgacgtcnatggcgcggcggccggtgatgagctcgagcagcacgacgccgaagctgtagatgtccgacatcttggtgagcttgccggtcatggcgtactcgggggcgcagtcaccgtacgttgccatgaccctggtgctgacgtgggtctgggcccccagggggcccagtttgggagcccgaatccgagcactggggttggattccctgtcagggaggagttgtgctcccttcgggccggggaaataaggggtggttgggcacgccgggaggggtct

SEQ ID NO: 5264 - DNA, 624 bp, Zea mays
  misc_feature (575)..(575): n = any nucleotide
atgctttggggcccctcccgagggatactcctagagcggccgcggatctcccccgtccaagcctcggccgccgcgagcaggatgccaagggcgattgcgagctgcaggaggagcggcaccagcgagggggtgccgccgccatggtcggggaagggccggatggttgctctttcaacatattctatcagcgaggatggaaactacattgcttatgggctaagtgaaagtggtagtgattgggtctctattcatgtgatgagcattactaacaagcagcctatgcctgataaattatcctgggtaaagttctcatctatcagctggacgcatgacgggaaaggttttttctatggtcggtatccagcacctagaggaggggaagtggatgctggaactgagacaaacatcaatcttaatcatcagatatattaccatgttttgggatctgatcagtcagaggatatattgtgctggaaagatcccgaacacccaaagtattcctttggtgcctcagtcactgaagatggaaagtacatcatattgggcatctatgaaggctgtgaccctgtcaacanattatactattgtgaaattttcttctcttcctcaaggaaaagagggctt

SEQ ID NO: 5265 - DNA, 792 bp, Zea mays
atgtgggacgggctggagagcgcggcgaccgtggcgcagctggtcggtctcgacgtcggcggcctcatcaccatgatcgggcaggcggcgcggaaggctcggcagaacaccaaggactgcgagcacctagcccgccgcgtcggcatgctcgcggagctggtcccccacctgcaggacccggaggccaggcgggcggtggccgggctcaaagatgcgctcgtggaggctcaccagctcatcacatcctgccagaggagggggctcacgtcccagctgttctcggcgtccaggcaggccgacaggttcagggacgtcgagcgcaagatcgaaacctgcgtgtccatcatccctgtcatcggctacatcggcataacaagacgcctcgatggttcgcaatcccagtcccagctgtcggcgggaggggctgaggatcgggagttcacgctggcggagatcgccgtggccaccaacaacttcgccgtcgtgctcagcaacgacgccgacactggcaccaaggtatacaagggaaggctcctgcagaacgggcctgaggtggccgtcaagcgccttaaccgcccgccggggggagcggaagacaccttcttcgcggagcaagacattcctctcgccgctccgtcacgaccgcattgtcccgctcctgggcacctgcgccgacgaacgggagcgcatgctgctcacccagtacatgtccaaaagggtcgttccacgacacactggacgggcacacccctgttgtcccttgtggggtccgcccgtgaacaaggttcgacc

SEQ ID NO: 5266 - DNA, 330 bp, Zea mays
atgctgcccgccgagatccatatgggcgtcggcggacgtgccggcggcggcgtcggcggcggcctgtctcttgggcgccttcttcagcccgagcagctccttccaccggatgttcggcgcgcggggcacgcggccgtggcgctcgtcggcgcgcagctcctcgcgcagcgtcacgggccgcgcgccgccgcctgcctgctgcggcgcctccctaagcggcaggagccggcccttggagaagagctggtcggcggccatcatcgggtggctgccgacggagaactcgaagtcggcgtcccccggccccgccgcgcccccgcgcgcggccgc

SEQ ID NO: 5267 - DNA, 186 bp, Zea mays
atgtcgtcctccctctcggtggccatgcgcagaaggccgcgcagctgcgcctcccgccacgccgccggccgcgtcctccccgacgcgaagctcctccgcagccgctccctctcctccaccgccgtcgccgccgccgccgccgccgcctccgcgtccatgccgagcgacgcccgccgcgccgctagc

SEQ ID NO: 5268 - DNA, 444 bp, Zea mays
  misc_feature (42)..(42): n = any nucleotide
  misc_feature (102)..(102): n = any nucleotide
atgcactacctgcacgcggcgctgacggagaccctccggctntacccttccgtacccatcgacgtcaagtgctgcttttcggacgacacgttgccggacggntacgctgtcaagaaaggggacatggtgaactaccagccgtaccaaatgggcaggatgcggttcctgtggggcgcggacgccgaggagttcaggccggagaggtggctggacgacgccggcgtcttcgtccccgagagccccttcaagttcacggctttccaggcgggccctcgcgtctgcttgggaaaggaattcgcgtacaggcagatgaagatcttcgcggctgtgcttctctacctgttcaggtttgagatgtgggatgccaacgctaccgtgggttaccgggccatgctcaccctcaaaatcgatcgcccgctgtatcttcgtacgtcgctccggcga

SEQ ID NO: 5269 - DNA, 702 bp, Zea mays
  misc_feature (595)..(595): n = any nucleotide
atggagctcccttcactccaagatactgaatctgatccaaatagctggctcaagtatactgtggctcctgcaatgcagcctactgaattagtagatccttacctgcagtctccatcagcgaccccttcagtgaaatctgagtgtgcatcgccgaggaacagtggtcttttggaagagctgcttcatgaagctcaggcactaagatctgggaagaaccaacaatcatcggtccgaagttcaagttcttctgctggcacaccttatgagactaccacggtggttagcccagagtttgatatgggtcaggaatattgggaagaacagcccagttctttcctcagtgaatatgctcattttagtggaaattctttcactgaatccactcctcctgttagtgctgcgtcacctgatatcttccagctctccaagatttctcctgcacaaagcccttcaatgggctctggcgagcaggcgttagagcctaaacatgagtcggcagcttcacctcgtcctgaaaacttgaggcctgatgcattattctctgggaacacagccgatccatccattttcaataatgccatagccatgctcctgngcaatggcattgatgccgagtaccaacctgttcttggtgatggaattgtgctcgattcttcgtcatggaacaacatgcaacatgcttttcagatgccggggatcaaa

SEQ ID NO: 5270 - DNA, 603 bp, Zea mays
  misc_feature (526)..(526): n = any nucleotide
atggggcaggacggccagcagatccgccgcgacaagctcatcatcgacacggatcccggcatcgatgatagcatgacgatcctaatggcgttcagagcacctagtgtggaaatcattgggctcacgaccatattcggcaacgtcgacacaaagggcgcaacacgtaacgcgctattgctgtgtgagagagcaggatgccctgaagttccagtagcagagggcagccatgagcccctaaagggaggaaagccccgtgttgctgatttcgttcatgggtcagatggcattgggaatctgtttcttcctgcaccctctgctaagaaggttgaggaaagtgctgctgatttcctgattaataaggtctctgagtttccagcagaggtctctgtgcttgcgttgggacccctgacaaatgtagcattggccatcaaaagagacccttcctttgcaagcaaggttaagaaaatagttgtactgggtggagctttctttgcggctggaaatgtcaaccctgctgctgaagcanatatccatggagacccagaagcagctgacatagtttttacttcaggagcagatattcgttgtggttgggcattaaca

SEQ ID NO: 5271 - DNA, 426 bp, Zea mays
atggggggggcgcgttgttggggtgtgttgtacacttatatgaaaattggtttggttctgattactcatcgggcgagtcaaagacgccggtgtcctggtcaggcgaccactcatcggccacagcgcgccgcgcgtcggccggggccagcgtcgcggagccggagcggtcgacgtcgaccacgtccgcgttcttgcggttcagcgccgcctccacctgcgccgccgtcgcgtcgccgtggccctcccgctcggtggcgctgctgctcttgtggggggagctcggacgagctccttcgcgcctgcagcccgaggagagaagggcgagcccgtcctgaccggccgcacggcggccggcgacgagcgccgctctcgtggccatgtacaagcagcagtcgcgctgatcggcgaagaaggcgcaccggagac

SEQ ID NO: 5272 - DNA, 381 bp, Zea mays
atgctaggtggtgtcgagaagaatctaaaaaatggaactcacttgagaggagatataaacatgatgatggtgggagatccttcagttgccaagtcccagctcctaagagctgtcatgaacattgcccctttggctatctcaacaactggcaggggttcatctggtgttggtttgactgctgctgtgacttctgatcaagagactggggagcgaaggcttgaagctggtgccatggttcttgctgatcgtggtgttgtctgcattgatgagtttgataaaatgaatgatcaagatcgagttgctattcatgaagttatggaacagcaaactgtaaccattgcaaaggcaggaatacatgcctcactaaatgcagatgtagtg

SEQ ID NO: 5273 - DNA, 534 bp, Zea mays
  misc_feature (37)..(37): n = any nucleotide
  misc_feature (197)..(197): n = any nucleotide
  misc_feature (338)..(338): n = any nucleotide
  misc_feature (382)..(382): n = any nucleotide
  misc_feature (411)..(411): n = any nucleotide
atgaattcagaggagagtaggtgtccccgcaaggagntttgggtttgcaaaggaccccccacagagcccttttttttatatgtcaaggaagattttgcggttggagttaccgaccagaagcatacccctaattccaattttatcggccgtcttcttggcccaaggggaaactctttaaagaggattgaaccctccancagctgtcgtgttttcatcagagggaaaggctcaattaaagattctggcaaggaggaacaactcaagggaagacctggctatgaacacttgagtgaaccccctccattcttgattgaagctgagttacctgctaatgtgantgatgcaagacttgcaaaggcacaagagatccttgaagagctgntgaaaccagtggacgaatcacaagactantacaagagacagcaactgcgagaacttgcaatgctaaattcgccactccgagaggagagtccacatccaggtggtgctcctcctagtcccttcagtaacggcggcatgaaaagagtgaaacaa

SEQ ID NO: 5274 - DNA, 588 bp, Zea mays
  misc_feature (355)..(355): n = any nucleotide
atgggggagcgggacgcccgccacacgatttcatggagcactgcctgcccacctgggccgcaaccaacaaccgtgggtatctttccccaggccacgcggggtgggtacttccctccacagcctggtccccgggcgaagggcccttggaggagccccgaggcccgggagaacctgcagcgcctgtggcaggaagtaccgcgtcgacatcgcctttttcgcccacgtccacaaatacgagcggacctgccccatgtaccagagccagtgcatgcccagcgagaagacccactactcagggaccatgaacggcaccatttttgtcgtcgccggcggcggcggctgccacctgtccagntacaccacggccatccccaagtggagcatctaccgcgactacgacttcggcttcgtcaagctcacggccttcaaccactcgtcgttgctgttcgagtacaagaagagcagcgacagcaaggtctacgactccttcaccatcgacagggactaccgcgacgtgctcagatgcgtgcacgacagctgcttccccaccacgctcgccacctagttaataaaactaccacttattgg

SEQ ID NO: 5275 - DNA, 324 bp, Zea mays
atgctgaaattggaaaaggctgatgtatacaggttaccgtatctatccagtggcgctcctggattcgctttgcttgaagctgccaggaagatcaatttccaagatgtactaagtagaatttccgccggattttcgtccaacggttgggaaaaaccaatactgcttgcatggggaatatctgacaagtacttaccgctctcgatagctgaggaattcaagcaagctaatcctggcgttgtaaaactagaggcgatagaaggagctggtcacatgccgcaagaggactggccggagaaggttgtgaaggcgctgacatccttcctg

SEQ ID NO: 5276 - DNA, 291 bp, Zea mays
atgttggacctggcccctcaggaaaaggattgtcccaaaactcccaaaccctttgtaacttgggtagtttccctggtagccactcctttcccccgccctggtttacatgaggatggcctaaaaccatactcccctaggcgatatggtcaagcaaatgctgccatagagcaaccttggagatatttgtatcatccaatatacaattgccctgatgggattgcggaccataataaagcctatatagttgaatttccagacataagtcccagctcagttacttatccaggtttc

SEQ ID NO: 5277 - DNA, 534 bp, Zea mays
atggatgaggagtacgacgtgatcgtgttggggacggggctcaaggagtgcatcatcagcggcctcctctccgtcgatggcctcaaggtccttcacatggacaggaatgactactacggaggagaatcttcgtccctgaatctaaccaagctctggaacaggttcaagggcaacgacagccctcccgagcacctgggcgtcagcaaagagtacaacgtcgacatggtgcccaagttcatgatggcaaacggcgcgctggtccgcgtcctgatccgcaccagcgtgaccaagtatctcaacttcaaggctgttgacgggagctttgtgtacaacaatggcaagatccacaaagtcccggcaaccgacgtggaggccctcaagtcgaacctgatgggcctgttcgagaagcggcgcgcccggaagttcttcatatacgtgcaggactacgaggaggacgacccccagtcccacgagggactggacctccacaaggtcacaccagggaaagccatctcccattaccggatggaagga

SEQ ID NO: 5278 - DNA, 186 bp, Zea mays
atgaggaggcagcgaagcggttggacgcggcggagggcgatgaggagggagccgaggaagaggaggatgaggaggaggaggtggagagccttgtcggcatcagcgacgcgctcgagtcgctcgagcggcagctcgccgcccttcaggatctccagcaccaacaaagatacgaacgggaaaccatct

SEQ ID NO: 5279 - DNA, 282 bp, Zea mays
atggactcaacgctgaaccaggtgaaggaggagagccatggggagggaggagatttgatggcaggcacggtggaggccgcggatgggccgtccgcggccgtcgccgcggcaccaaagccgatggagggtctgcatgaccctgggccgccgccgttcctcaccaagacatatgacatggtcgacgactcggacaccgacctgattgtgtcttggagcgccaccaacaacagcttcgtggtgtgggatccgcacggccttcccacggtgctgctgccaggcact

SEQ ID NO: 5280 - DNA, 372 bp, Zea mays
  misc_feature (151)..(151): n = any nucleotide
atgtctccccacgggaacacccagtctggtgtctggtgctacgtcccccgtcaaaacctcgaatcgaggctcacatgtcaatggcccccctggtatccatcaaagcaagcattcctcggcggcaaactcgcctccacgaggacgttcaacnccaggtcgcactcctcgaatcgatggaaaggagtctttcgtcaggccaggagtcgtctatcctacgagcaatttggagcattcttagccaacatcaaagagctcaatgcccataagcagtcacgtgaggaaactctcaagaaagccgaagagatctttggtccagacaataaagatctgtacctgtctttccaaggcctgctgaaccgtagcatggtggca

SEQ ID NO: 5281 - DNA, 537 bp, Zea mays
atgggggccagcctgagcctggtgccggtgctcgactacttcgcccgccgcgagtgcctgcgcgccggcctccaccagaacgccgtcacgctcccgtaccccgacggcggcgccggggcgacctgcaccgtccagtactgggctccgcagggggagcctgagctcccgccgctcctgctggtccacggcttcgggccccgggccgactggcagtggcgctgccaggtggggccgctctcgcgccacttccacgtcatcatccccgacctcctgggcttcggcggcagcgcgtacccgtccgagacggcgccgccgccgacggaggcgacgcaggccgcggtgctggcggcgctgctgggcgcgctgcccgggatggagcgccggcgcgtggccgtggcgggcaccagctacggcgggttcgtggcgaactggctggcccgcgaggcggggacccacagggacgaacccgtgctgatccccagatccgaactgcatcaaaattatgccgcctatagggcgtataatgaatatcctcta

SEQ ID NO: 5282 - DNA, 600 bp, Zea mays
atgagtaacaggtatatccttacaggtgcagcatgggtaactgatgcctacaacaaggttgcaaccactacaactgatgctagcaagtcgataaaggaaaggatgatggctgagcaggagggagccaatcagagcggtgaaaccgcaaaagttgatttgcttgaaatctctgaagcggatgagcaagagtggaagcgccatgaagatgactctgcaaagaacgctgttcaagaaagtcctgaaatgacttgtcaggagagtgagcatcaggcgggtgaacgtcaaatgactaatgtagcaggtaactctaaaacgggtatagaggagcataaaaatcacgagggtgaaatagcagtagtagctcacatgcaagaaaacatggatacagctgagaagaatcctagctgccacgagagtgaagtatccaaggccaatgttcatgatagcgttctaatgacagagcaaagtgagcgagagcataatcaatgcgaaggtgaatttgcaaacagtcatgtcccaggaagccctgtcactattccggtcaccgtgtccactattgacgggaactctagcaacagtcccaagaagcctgattctgcc

SEQ ID NO: 5283 - DNA, 378 bp, Zea mays
atgtctgaggttgtcaccatcaagtactacgtgaggtggcctctgcaatgcaactcacgactcagtgcacatgcaagagtacttttccctgaaccactgagtcctgttatccatacgacacagcctttttgtcccagcaatttctgtctatcagattgtccaatcaagcaattgtgccataaaatattagtcgatttcccaatgtttgacattacaggcttctccttcactgggctgtgcggggcatccccgtggcgctgctccattccgccgccgccgccgcacccaccgcccaatgccgcggtggcagtgcgtacgcgcaccgcggccctccccctcgcggcgcccactatcgctggcgagacccgcggaagagtg

SEQ ID NO: 5284 - DNA, 558 bp, Zea mays
atggcgcgccgacgccggcggcgcggagaaggcggagcgcgcgctgggcgcgaacgccgcggcgcgcggagccgcgtcgtagccactctggtagaagcagggggcggcggcggagccgagggacaggtcggtggtgcaggtggacgcggtctcgtcggactcgccgccgctgtgcgcgcgggtgtccgctgccgtgtactgcgcgtgagcggcggcgacggtgcgcggaggcgagccggcgtggtgctggtggtggtggtggtggaggacgacgacgggcgccaagtgcgacgtcggcggcgccgggtccggcgaggacgagggtttgcgccggcggagcgcgccggtgtgctcccgctgcttgcgcgccatgaggacgtgccagtggttcttgacggcgttgtcggtgcggccggggaagaggcgcgcgatgagcgcccacttgttgccgtacgcgcggtgcgccgccagcagccgctcctcctcctcgccggagaaggcccggcggttgatccgcgggtccagctggttgaaccaccgcaggcggcagctcttccc

SEQ ID NO: 5285 - DNA, 450 bp, Zea mays
atgcatgccgactgtcaaatgaaggctgcatgcacgtcgccccccgcaatcacctcgatcgaccgactgtcaaatgaaggcctggaggaggccctcgcgcagcgcgcgctgccactgcggcacggccgggcggaacaccagcgcgcgctccacccagcggtaggacgcgttgacgaggcggtggtcccacccggcggcgcgcacgtagccaccgctggcacgggtgtagaagccggcgttgaggcagctgccgccgccgagcacgcgcgcgcgggcgttcacgacgccgtcctcggagacgaaccgctgcccgtgtccgtgcgaggtgaatcgaatgggcgacaaaacctattgcagcaaccctcgctcaccaccggcattcgcagcttaattaccttccggcgaggcggtgaccacggtaatgcaagaggagcccagaaggacggtgcc

SEQ ID NO: 5286 - DNA, 108 bp, Zea mays
atgttggtgcggctactgttgagtatctttacagcatggagactggagaatactattttctggagcttaatccccgactacaggttgagcatccagtcactgagtgga

SEQ ID NO: 5287 - DNA, 159 bp, Zea mays
atggtacgatcgttcaccaactgcacattgcacaactctggacttctcaagcaaaaatgtttgaatcatggcaccacatattcttccagtggtactgaaatgaatttcgataagctttccctgcaattgagaataaagattgatcttcattcgaagctg

SEQ ID NO: 5288 - DNA, 741 bp, Zea mays
  misc_feature (466)..(466): n = any nucleotide
atggcgcgcaaggtcctgctgctggtggctgccgtagccgcgtgcctcgccgcgacggttcgcgcggggtggcagaggggctcggcgacgttctacggcggggccgacgcctccggcacgatgggtggcgcgtgcgggtacggcaacctgtactcggcggggtacggcgcgagcacggcggcgctgagctcgacgctgttcaacgacggcgcggcgtgcgggcagtgctaccaggtgcagtgcgaccagcagaacagccggtggtgcaagccgggcgtggtcgtcaccgtcaccgccaccaacctgtgcccggccgactactccaagcccagcaacgacggcggctggtgcaacccgccgcgccagcacctggacatgtcccagccgtcctgggagaagatcggcgtctacagcggcggcatcgtcccggtcttcttccagcgggtgtcgtgctccaggagcggcngggtgcgcttcaccgtcaacggcaacaggtacttcaagctggtgctcgtcagcaacgtgggcggcccgggctccgtcagcgccgtgcagatcaagggctcctacacggcgtggatcacatgtcacggaactggggcgccaactggcaagaccaacagcgacctcaccggccagagcatctcctcccgggtcaccgcgccccaacggccagtttcttcagttagacaacgtccccggctctggctggcagctggcccagaccttccccaacggcaa

SEQ ID NO: 5289 - DNA, 681 bp, Zea mays
atgctgggcgcgcgtgtgcagctgaaggggtggcaacaggcagctgttgcatttggttctgcgtttggggccttgcttgaccctaggagggctgatcttatagctgctcttggagagactactgggaaaccagcgtttgagcgtgtgctgcaacgaatgaagaacagtgcagaaggcagggaagttctctcggagcgtccccgcgtggtatcctcgcaggtttcccatgcctgggacctgcctcagaacacatttggcgcggcgtatgctcagttcatgggatcaaggaacttctcaccagacgatcgcccacctgtccgtttcatggacaccgatgagctcgcctacgtcgcgacacgtgctcgcgaggtgcacgacttttggcacgtgctgtttggtcttccgacgaacctgattggggagaccgccctcaaggtgatagagtttgaacagatgttcctcccaatgtgcatgctgtcagtcgtcgggggctctgcgaggttcagcgacaaacaaagggcgctgtttttccagcactacttcccatgggcaacaaaagctggtctcaagtgtactgatctgatgtctgtatattacgagaagcactttcacgaagacctggaggtagtgagaaggaactggggaatccttccttgccccagtcccaaaaagagcagtgta

SEQ ID NO: 5290 - DNA, 564 bp, Zea mays
atggcgtcgccggcgcggcggctcctgcagaccaactccgtgcagtacccgacgctccccgcggccgacccgccgagcccgctggccgtcgactccgacgtggtggtcatcctcgccgcgctcctatgcgcgctcatctgcgtcgtggggctggcctccgtggcccggtgcgcgcgctcccgcgccgcgcccgccgccgccaggagggggctcaggaagaaggcgctcagggcgctgccgagcctcgcgtacgaggacgccgtggcggcccgggccggggacggggcggcggaggtcctggcggagtgcgccatctgcctctcggagttcgcgccacgggaggaggtccgcgtgctgccgcagtgcggccacgccttccacgtcgcctgcatcgacacctggctcgccgcccactcctcctgtccctcgtgccgccgcgtcctcgtcgtcggcgacgccgccagtaagcgcccgccccagcctaagcgctgccgcaagtgcgaggcggccatggacgaaccctcctcgtcgtccggttccgccggcgacacggctaccggttcc

SEQ ID NO: 5291 - DNA, 450 bp, Zea mays
atgctatggaagtcgtcatcctccgtgtcggccttcgccttcagctccgcgctccggacgatgacctcgatcctcgccaccacctcggccatccgaggccgccggtccggccggtcgtcggtgcattccacggcgagctgcagcagccgcaccatctcctcctccacgcgctcctcgaccgcgatgctggcgtcgaacacctcggccgtccactcctcctgcaccaccgtgcgcacccacagcggcagctccacgccgccggtgctcccggggaccgagttcaccggcggcttccccgtcagcgcctcgaggagcagcacgccgaagctgtacgtgtccgtctcctgcgacgccctgcgcgggtcggtgacctcgggggcgcggtacccggtgacgcgcttcaggggcacgtgcgcgccgacgagccggaggatgccgtggtcggtcacg

SEQ ID NO: 5292 - DNA, 765 bp, Zea mays
atggcggtggtgggcgtcctcgcgctgcagggatcctacaacgagcacatggccgcgctgaggaggatcggggtgaagggggtggaggtgcgcaagccagagcagctcctcggcatcgactcgctcatcatccccggtggcgagagcaccaccatggccaagctcgccaactaccacaatctgttccctgcacttcgagagttcgtcggaggtggaaagcctgtctggggaacctgtgctgggctcatctttcttgcaaacaaagcagtagggcaaaaaacaggggggcaggaacttgttggaggattagattgtacagtccaccgaaacttttttgggagtcagcttcaaagctttgagacagagctttccgtgccaaagctttcggagaaggaaggagggaatgatacatgccgcggtgtatttatacgggcacctgctatattggaagtaggtccagatgttgaaatattggcggattgccctgttcctgttgacagacccagcattacaatatcatttggggagggtactgaggaagaagagtattcaaaagatcgggtaattgttgcagtgcggcaagggaacatcctcgcaactgctttccacccagaattgacatcagactccagatggcatcgtttcttcttggacatggataaagaatccccagcaaaggcgttttctgcgctctccctgtcgtcatcgtcaagagacactgaaggcctgccaaagaataagccgtttgatctgcccatttttgag

SEQ ID NO: 5293 - DNA, 861 bp, Zea mays
atggcctcccccgacctgctcttcaatctgcggaacctcttctacctgggcgcctaccaggcagccatcaacaacagcgacgtcccgggcctcgacgccgacgccgccgctgagcgcgacgccatcgtcttccgctcctacatcgccctcggctcctaccagctggtgatcagcgagatcgactcgtcagccgctacctcgctgcaggccgtgaagctgctcgcgctgtacctcactggagacaaggaaggtgctatctccagtctcaaggaatggttgagtgattcagcaattggaagcaatcctgttctgcggttgattgctggaattgtatttatgcatgagcaggactacaatgaggctctcaagcacacacactctggaggaactctggatttgcatgcattgaatgtccagatcttcatcaagatgcatcgttcagactatgctgagaagcaattgaagatcatgcaacaaattgatgaagaccatacacttacacaacttgcaaacgcatggctgggcattgctgttggtggctctaagatccgtgaagcttatctcatattccaagactttgctgaaaagtacccaatgacagggatggttttaaacgggaaggcagtctgctgtatgcacatgggaagctttgaggaggctgagactctgttgcttgaagcgttgaacaaggacgcaaaagatcctgaaactcttgcgaatctaattgtatgtaatctccacttaggcaaaccatcatcacgatacctcagccagctgaagctatcgcatcctgaccatgtgctagttaagaatgcggcagcatcagaagcgaccttcgagagggccctccaagccgttgct

SEQ ID NO: 5294 - DNA, 342 bp, Zea mays
atgcgcgggggcaggtggtggtactggtgcaggtgctggcacggcggcggcggcggcggcggcaggagcggcgactacaccgactgcgcgtaccactcgtcctcggtgcgcagggacgacgcgcgcgaccggggccgcgccgtgtcctctccacgattcttggggctccggtcgtacccgcctccgtacgacgccgactcgatgctcgcggacaagcgccggctgtacgccgccacgccgtgctcgctgcgcgtgtcgtcaccgtgccgctcttgcagcgagaagcgcgcgcggacgggagggtggtggtggaggggcgggagcgcgggtagcgcgcggctg

SEQ ID NO: 5295 - DNA, 390 bp, Zea mays
atgacacacacacacatgcttcacaagattcaaatacaaaatacaatcacaccacgtcgagggttgcatagatttagctcgacgtccttattcatctttgcactacacacatgcatgcataaacatgcatggcttggccataaacatgaacatagatacggctacctccaccatcccagaatgattgaaacgattgaaacagagacaagtgatgagcaacaaggcaatctagtttcctccacccccacctcctcctccagtaccaccaccaccaccgcctccaccgccgccacctccgccgccgccgcctcctcctcctcctcctccacctccacctccaccgccccctccacctccgagagactggtggagttgctgagcaagtatcct

SEQ ID NO: 5296 - DNA, 255 bp, Zea mays
atgcctctcctcagtattcctattatttccaccttgaccactgtacacgagcacatctgtgtcatcatcctcattctcataacctcctgcagagacaatacatatggctacagaatcctcatcttttccaaatttagtagtcatgtaatcaatgcctcccatactaggtgcatgcaacccaatgacacacagctccatcctaaaatagaaaatatctcctatttcaactccaggtacagttcctaccctcttgcc

SEQ ID NO: 5297 - DNA, 303 bp, Zea mays
atggacttcctgcccgccggcgacggctccgggtgccccaagggcgggccgcgctgcgacgccgacgtcacgtcgcagtgccccgccgcgctgcaggcccccggcggatgcgacaacccctgcaccgtgttcaagacggaccagtactgctgcaccggctcggcgacggacaactgcgggcccaccgactactccaagttcttcaaggggctctgcccggacgcctacagctatcccaaggacgacgccaccagcacctacacttgccccggcggcaccaactacaacgtcgtcttctgccca

SEQ ID NO: 5298 - DNA, 381 bp, Zea mays
atgatagtacttgcagaaccagctcctggagatatggtaagagctgtcaagaaagccatcgacatgctacctggaatagacccccagattatgcatcttcggatgaaagaactttatagttgggacgatgttgccaaaagaactgagattgtttatgatcgtgcaatggaatctccaacaacaaatttactagatcgccttcctcggtatcttacttgtggatcttgggctggaaaactgttttgcctagttatgatcatcaattacctactatggcgccttttagaatttctacagcctgctgtaggtattgaagaagtcccagatatagggccactacatgctcatttaggttcaaggaatgatgaggctcaagagaag

SEQ ID NO: 5299 - DNA, 507 bp, Zea mays
atgggctacgaccattctgctgtgaacaaggaaatcgggtcagcatcgatcacaggcggatatgtgtaccgaggttccgctgacccctgcttgtacggaaggtacctctacaccgacctgtactcatcgctgatgtggacgggcacggaggccccagaggggagcgggaactacacgtcggccgtgaagccggtgagctgctccaaggcctccccgatcggctgcgagtccgtcgccgggagcacggacccgctgctcgggtacgtcttctcgttcggggaggacagccgcaaggacgtcttcgtcctggcgagcaagggcgtgtaccgcgtcgtcaggcccagcctctgcggctacacctgccccgcggagagaccggcgaccgacaacggcaccgcgccaggtccaggcgggccgtcgtcgggcgctcccgccgcgacacggctagggaggtcggtggcggcggtagcggtagctctggcgttgatcccgtgtgtgctgttactg

SEQ ID NO: 5300 - DNA, 324 bp, Zea mays
atgccgatctccccggacagctcgttgttgtccacctcgacgtcggtcagcgacgtgcagttggagagctccggcgggatgacgccggtgagcttgttggtgctgagctgcagctgctgcaggttcggcagcgtgccgaagctgctcgggatgggccccgtgagcgagttgagcgacaggtcgatgagcacgaggtccttgcagttggcgatctccggcgggatagtgccgacgagctggttctgccacagcagcaccgtctgcagcttgcgcagctggccgagctgcggcgggatgggcccggagagggagttctggtacagg

SEQ ID NO: 5301 - DNA, 366 bp, Zea mays
atggcgcccgagttgctctccttcttctcgaccatcacggcgttcaacctcatcctgatctactccatcgagctgttcccgacgtccgtgcgcaactctgcggtggggctggtgcggcaggcgctggtgctgggcggcgtggtggcacctgtgctcgtcgcgctcggccgcgaacggagcttctggtccttcggcgtgttcgggctctgcatcggatgtttggggctctttgccgcctgcctccccgagacgagggggcggagcatgtcggacaccatggaggaggaggagcacaaggaggccgccgccgcggcttgcaccggcgcaaccgacattgccacgaaggatgataccgacctgctcgtg

SEQ ID NO: 5302 - DNA, 603 bp, Zea mays
atgggttcacccttgttcccccgacccgggttggtcctgttcccccacggacccttccagccagggcggacccggaacccggaccgagggccccggtgcacaaagttggggcccttcagcccttcgttagtacttgcgccactgggaggacatgggacccagcgctttcccggtgcagaaggtccacaagatctgcgtgctggacatacgcttccccaacgccgatcgccacgcccgaaacatactcgtccgcaagcacgacgccggcggagcgggaggcatgtcgctgttccccatcgaccatggatactgtctgccggagagcttcgaggactgcactttcgagtggctctactggcctcagtgccgggagcccttcagcgacgagacggtggagtacgtgcggtccctggacgcggaggaggacgtgactatgctgaggctccacgggtgggaggtgtcgcgcgagtgcgcgcgcacgctgcgcgtcgccaccatgctgctgaagaagggtgtggagaggggcctcaccgccttccacatcgggagcatcatgtgcagagagaccctgaccaaggagtccgccatcgaagagatcgtccg

SEQ ID NO: 5303 - DNA, 618 bp, Zea mays
atggggcggccgccctgctgcgagaaggcgcacaccaacaggggcgcgtggaccaaggaggaggacgagcgcctggtggcctacatccgcgcgcacggcgaagggtgctggcggacgctgcccaaggcggcgggcctgctgcggtgcggcaagagctgccggctgcggtggatcaactacctccggcccgacctgaagcgcggcaacttcaccgccgacgaggacgacctcatcgtcaagctgcacagcctcctcgggaacaagtggccgctcatcgccgcgcggctcccggggcggacggacaacgagatcaagaactactggaacacgcacgtccggcggaagctgctgggcaggggcatcgaccccgtcacgcaccgccccatcgccgccgacgccgtgaccgtgaccaccgtctcgttccagcccagccccagcgacgccgccgcagcagcagcagaaaccgaggtgacggccgccaaaggcgccagatgccccgacctcaaccccgacctctgcatcatcccgccgtgcccgcagaaggaggaggaggaggcggtggacctccaaccctccgccgccgtcgtcaaccggtaccgtctggcgggtacgcccctc

SEQ ID NO: 5304 - DNA, 132 bp, Zea mays
atggcggcgttggtcatgttggcgcggacgccgttgcgcttgcacagcgcctggagctcccggcgcgagagcgtgtggaaatccatggccgtcgccgcctccatctccctcacgtctcttaccttctcctcc

SEQ ID NO: 5305 - DNA, 570 bp, Zea mays
atggtcggcaggggcagcctgggcaccgtgtaccgcgcggtgctgagcgacggccgcatggtcgccgtgaagcggctgcgcgacgccaacccctgcgcgcgcgacgagttccaccgctacatggacctcatcggccgcctccgccacccgcacctcgtcccgctcagggccttctactacgccaggcaggagaagctcctcatctacgactacctccccaatggcaacctccacgatcgcctccacggtcacaagatgtcgggagagtcggcgctggactggacgacgagggtgcggctgctgctgggcgcggcgcgcgggcttgcgtgcatccaccgggagtaccgcacgtccggcgtgccccacggcaacgtcaagtccaccaacgtcctgctcacaaggacggcgcgggcgcgcgtggcggacttcggccctcgcgctcctgctcagcccgggcgcacgccatcgcgcggctggggggtaccacgggcgcccgagcagcaggacgacaaggcgctggtcgcagaggccgacgtgtacagctttcgcgtgctggtccctggaaggcgc

SEQ ID NO: 5306 - DNA, 444 bp, Zea mays
atgcttagtctgttgcaccatgacaatctagtaaacttaattggatactgcgctgatggagaccaacgtcttcttgtatacgagtttatgccattgggatcacttgaggatcatttgcatgatattccacctgataaggaacctctggactggaatacacgtatgaagattgctgctggtgccgccaagggcttagagtacttgcatgataaggcaagtcctcctgttatttacagggatttcaagtcctcaaacattctactcggtgaagggtttcatccgaagctatcagacttcggccttgccaaacttggccctgttggtgacaagactcacgtttcaacacgtgtcatgggaacttatggctactgtgctccagagtatgcaatgacagggcagcttacagctaaatctgatgtatataagttgtggtgttgtgttcct

SEQ ID NO: 5307 - DNA, 453 bp, Zea mays
atgaagaccgtatcagtggggaggaggaggttcagtgcagagttccagctagtgttccggctgatcaagggtctcatatttataacttttacagccatcgtggtaatcctaatagcaatccctggcatgacggttctggacatctttgtttgcatccttgccttcatgcccactggatggggtttgctcctgattgcccaagctatcaggcctgtgattcaaaagatcgggctgtgggggtcgatcaaggctcttgcccggggctacgagatcctaatggggcttctcctgttcacgcccattgctttccttgcctggttcccgttcgtgtccgagttccagaccaggatgctgttcaaccaggccttcagcagaggtctgcagatctcccgtatcatgggaggacacaagaagaccgagggacgcggagcaaggagtagtagggctgctgat

SEQ ID NO: 5308 - DNA, 720 bp, Zea mays
atggcgagctctcagtgctgcgataacccgccggccctgaacccggcctgcggggagggcaaggtcgtcgacagcttcggcgggctcaaggcctacgtcgccggccccgaggactccaaggccgccgtcgtcctcgtcgccgacgtcttcggattcgaagcgccgattatgaggaagatagccgacaaggttgcttcgtcagggtactttgttgtggtaccagatttgtttcatggggatccttatgcacctgagaatgttgagaagccctttcctgtgtggataaagtcacatactccggaaaaagggtttgaagagacaaaacaagttattggggctctaaaggagaagggagtgtctgctgttggagctgcagggtattgctggggtgcaaaggttgttgtggagttggcaaaagctcatgagatccaggctgctgtgctgttgcacccttcttttgttaccgttgacgatatcaaagaggtcaagtgcgcaatttctatcctcggagctgagattgacaaaatgtccccaccggagctaatcaagcagttcgagcaggtcctttctttgaactcaggggttggccacttcgtcaagatcttccctggtgtggcgcatggatggagcgtgagatacaaccacgacgacgcagctgccgtgaagagtgctgaggaagcctttgcggacatgctcgactggttcaacaagaatctgaaa

SEQ ID NO: 5309 - DNA, 618 bp, Zea mays
  misc_feature (560)..(560): n = any nucleotide
atggactggagcgcggtgacggcggaggacttggtggacgcgctgcgggaggtggactggtccatgccgccgcggcctgtcccggagttcttctcccgcttcaccgtcccacgctcctactccaagtggaccagccgcctcaagtgcaacctctactactacaggacaaactatttcatcttgatcatgttcatccttgggatgggcttcctttggaagccagttgctatagttgctgcttttatgactggacttagcatcgcatttctcaatgatagttttgcagtcactttcaatgagaaagtcacaaggaccgtaagacaattttcaccacatttagctgcaaagttgaggccacctataactcctgttcttcgcggtcgaccaagctctaagagatcaattcatatttgtgggcgacctcgctgggtgtttgtcctgttcttttctgcagtgagctgtatactctggttgacctcatgcagtcttctcacagtcctctgggcacttctcattgctctatttgcaactgtgctccatgcaagcttcagaacaccaanatctcaaagcacgtctgaatacattcagagaggaattccgggctgtttggcggaatta

SEQ ID NO: 5310 - DNA, 621 bp, Zea mays
atggtggaatccgtggcgccgcggctgccgaacgtcactttcctcgacatcagcagctgcacgaagatcggggcccgcgggctggaggcgttcggcaagcactgcaagtccctggcggggctgcggcgggtgatgcacccgatcgacctggcggacagggcgtgccagcacgacgaggcgcacgccatcgcgtgcagcatgcccaggctgcggcacctggagatggggtacatgctggtggcgacggaggcggtggcggagatcctggggcggtgccgcgagctcaggttcctggacctgcgcggctgctgggcggtggacgacaagctcctgctgcgcgaccgccacccggggctgcgcgtcctgggaccccgcgtcgacgactgctacgagaacagctactgggaggagtgctccgacgactactcggacgactcctccatctactcgtgggagctcatggacgacgtcgacgacgactacgactacgccgccgccggcagcgacgacgacgaggccgtctgggacgacgacggccagggcctggagaacctcgaggtcaggttctacggcggtggcttcggcgagaccttcgccggcttcgactggccgccgtcgccg

SEQ ID NO: 5311 - DNA, 147 bp, Zea mays
atgccaagagccccgagagcagcagctccggctccgcctccgcctccgcctccgacgacgccagcgccgcctcgccggcggcgccgcaggacgccgagcccaacccggacgacgcgctgttcgacctcccggacctgcttctggacc

SEQ ID NO: 5312 - DNA, 324 bp, Zea mays
atggagtcgacgccgcggatggtggacaggcggtgcgccaccagcacggcggtgcggcccttcatgatgcgctccagcgcctcctgcagcacgcactcggactcggcgtccagcgcgctggtggcctcgtccagcagcagcacggcggggtccttgagcaccgcgcgcgcgatggcgatgcgctgcttctggccgccggacagctgcaccccgcgctcgcccacgggcgtcctgtacccgtcggggagcgcgctgacgaagccgtgcacgttggccaccttggccgcctccacgacctcctcctccgtcgcgccgtccctgccg

SEQ ID NO: 5313 - DNA, 396 bp, Zea mays
atgccgtcatcgtcctccgagctgaggagctcagggagctggtggtgctgcttgttgccgccgtgctggttcttgaacgccttgaggccctgcacgaggcccccaccaacccctcctcctcctccttgcttcccctggtcctttttctggccgccgttgttgttgctgctcttgctgtgcccatccttgctcggattgccaccttgcttctgctgctgttgctgctgggcctgctgcttctgctgggcactgccgcccttgtgctgcgaccacagctccgcgtgcttgccgcccctggtgagcttcctgatcaaggtctccgagtccacgtcgcctgtcaccgacaccttgtggttgtccacatcaatggccaccgagtacacgccttcgatcttc

SEQ ID NO: 5314 - DNA, 468 bp, Zea mays
atggacggttcgaagagcaatgctcaccaacaaggcgcggcggtgactagcaccaccagctcggcgggcaagcgcaagggaaaggcggcttcatcttgcggcggcggaaagaagccacctatcaaggtggtgttcgtcggcaaccccgtgcgggtgaagaccagcgtggcgggcttccgcgcgctggtgcaggagctcaccggccgccacgccgacccgtacaagcacagcgttggcgacgccgacgccgacgacagcagcagcggtggcagtggcagcccggtggagctgcaggtgggcggcgcgctgtcatcggactccgcctctgctgccggcgtggcccaagtcatctcagtgccggcttacgacgacgacgacgacgacggcttcgcgccacagctgatcgacaacagctactccgtgttctcgccgcccacgttcctttacggcccgcacggcggcgagctg

SEQ ID NO: 5315 - DNA, 315 bp, Zea mays
atggtgaacgttcctaagaccaagaagacctactgcaagaacaaggagtgcaagaagcacactctccacaaggttactcagtacaagaagggtaaggatagcctgtctgcccagggaaagcgccgttatgaccgcaagcagtcaggatatggtggccagaccaagcctgtcttccacaagaaggccaagaccaccaagaaaatcgtattgaagctgcagtgccagagctgcaagcactactcacagcacgcaattaagaggtgcaagcattttgagattggtggagacaagaagggcaagggaacatctctcttc

SEQ ID NO: 5316 - DNA, 117 bp, Zea mays
atggaacaggagggttacaggatcctaggcaactccggcgaccaatggagcgacctgctgggatcttccatgagcgctcgctctttcaagctccctaacccaatgtactatatcccg

SEQ ID NO: 5317 - DNA, 258 bp, Zea mays
atgaatgactggtggtatatgtatgcaaacactgccataaccatttggcaatccattctatcagtaattccaccatgcccaggtatgctgtcaccaaaatcctttattttgaaagccctcttgaagccactcgcaaaaaatcctccgaatggtgctattattgacgcaaataaacctagggctaaagcatgccactgcacaggcataatggctagatctttccatgggaaccaatgtggcaccgactctcccaatgag

SEQ ID NO: 5318 - DNA, 555 bp, Zea mays
atgaaaggcgccgtcatcggcgcatcgaccgtcctggtcgtggcggtggtggccaccatctgcgtcgtttccttcaaaggcagcggcgatggcgggagggccgaggagggcgagatgtccacgtcggtgaagtccatcaagtccttctgccagcccgtggactacagggagacgtgcgagaaggcgctggaggcggcggccgggaacgccaccagccccacggagctggccaaggccatcttcaaggtgacgtccgaccggatcgcgaaggccgtgcgcgagtccgccctgctcaacgagctcaagcacgaccggcgcacgtcgggcgcgctccacaactgcggagagctgctggactacgccatcgacgacctccggacgacgttcgacaggctcggcggcttcgagatgaccaacttcaagagcgccgtggacgacctccggacgtggctgagctccgcgctcacgtaccaggagacgtgcctggacgggttcgagaacccacgacgcccgccgcgggcaagatgcgcaaggcgctcaacagctcgcaggagc

SEQ ID NO: 5319 - DNA, 240 bp, Zea mays
atgcctaatgccaaaccattgggccttggccgagcaggcactacaatcgacagagatgaacacaagcgctttgtgagggaagttcacgaggaagtaactgaggcaaggcagaaggcctcaacagtaagatctcgacgacaagagcaggatgctgctcgtagagagaaactcaggcaagcttacctgaagaaacgattggagaagttgattgctgaaaaacaggcctcttcaaccagtgat

SEQ ID NO: 5320 - DNA, 765 bp, Zea mays
atgtcggtctcggcgtcgtcaccggcggcggcggcgggcgatgagaagcaggaggcggcgcccgtcaggcgctgcaagggcgtcaacgacctcgacaaggtcgttctccgcgaggtccggggcagctccgcagaggtgtacttgtatggtgggcatgtgacatcatggaaagatgagcatggagatgaattactttttgttagcaataaggctattttcaagcctccaaaagctatacgtggaggaataccaatatgctttccgcagttctccaactttgggaatctggaaccacatggatttgcaaggaataggacatggagtgttgatgatgatcctccaccatttccagtgccaacctccaatagcgcttatattgacttgatcctcaaacctactgaagatgatttgaagatctggcctcatagttttgaataccgcctgagggttgcacttagtcctggtggtgatttgatgctaacttcacgtataagaaacactaatgcagacgggaagccattctctttcacttttgcataccacacatacttcaagatttctgatatcagtgaggtgcgagtagaaggattggaaactctggattacctagacaacttacaagatagagctcgttccactgaacaaggcgatgcaatttgttttgaatccgaactggacagaatatatctgggcacaccatcgaaaattgccattattgatcatgagaagaaaagaacatttgttgtgaggaaaggaggcccttcc

SEQ ID NO: 5321 - DNA, 435 bp, Zea mays
atgccaactaaaccaattattgatgatccagccattgttgagcagaacaaggaaaaggtattcgaagaatggaaatctatgcgcagggctgagctgactcggtttcaaaagcaagttgaggagcaatatctctcaaatgtggagaggcaattggagaggatccagaatgcccggaacgctcggaaggcgaatgggcctggtaacatgcaagaaatggacaaggagctggacacccacagggcggagcatggtccaaagcctcggcgagttcccgaggagggcggcaatgatgatgacgaagatgcagaggacatggctgcggaagacgagctgatggatgaagttttgggcatcaacgatgcaatcaatgaggacccatccaagccgtccgaagaagctactactgaaggtcagccagcaaccgaggaagcacaa

SEQ ID NO: 5322 - DNA, 831 bp, Zea mays
atgtacctccgttgtttctccggcgaccggccgcgggactggttgtggtggctgccttgggcagaatatacatacaacacagcgtaccagtcttctctacaggagacaccatttcgggtggtatacggtcgcgaaccgcccaccatcagatcatatgaagtaggggacacgcgcgtggctgctgtggcccaaacaatggccgaacgtgaagaattcttggccgacgtccgtcaccgcctagagcaggcccaggcaatccagaagcgctactacgacaaagctcaccgccatgtctcctatgccgttggggactgggtgctcctccgactccgtcagcggccggtggcttccatttctcaggcgccgaggagcaagcttcagccccgcttctttgggccgtaccgagtcaccgagctcatcaatgaggtggttgtacgtctcgagttgcctccacgcgccaagcttcatgatgtgttccatgtcggcctcctcaagaaatgggtgggcgagcctcccgcgacaccaccaccgttacccgctgttcatcatggagccatcgaccctgagccggaacgtgctgtacgcactcgcatcgctcgcggggttcgacaggtgctcatccgctggaagggagaacccgtagcttcctccacatgggaagatctcgacgccttcgccgccaagtacccagcgttccagctcgaggaagagctggtgatcgagggggggagagatgtcatgtacggcatcccctactccaggcgacgtcgcgcccgcgacgtacgcagggcggccgagcgtgcagcacaggaggcggctgcccaaaccaac

SEQ ID NO: 5323 - DNA, 198 bp, Zea mays
atggcaagcaaaaggattcagaaggaactcatggatctccaaaaggacccaccgacatcatgcagtgcagggcctgctggagaggatctattccactggcaggccacaatcatgggtcctagtgacagcccctatgcaggcgggttttctttattaatatccattttcctcctgactacccctttaagcctccaaaag

SEQ ID NO: 5324 - DNA, 426 bp, Zea mays
atgccgaagaacaagggaaagggaggcaagaaccggaagcggggcaagaacgaggcggacgacgagaagcgggagctggtgttcaaggaggacgggcaggagtacgcgcaggtgacgcggatgctgggcaacggccgctgcgaggcgctctgcatcgacggcaccaagcgcctctgccacatccggggcaagatgcacaagaaggtgtggatcgccgccggggacatcgtgctcgtcggcctgcgcgactaccaggacgacaaggcggacgtcatcctcaagtacatgaacgacgaggcccgcctgctcaaggcctacggcgagatccccgacaacgtcaggctcaacgagggcgtcgttgatgaggaggaagccggcgcgcaggatgactatatacagttcgaggacgaggacatcgacaagatc

SEQ ID NO: 5325 - DNA, 1143 bp, Zea mays
atggacggccgcatcgacggcgtgcggctggtgcacagcacggcgacgcgcagcacgcggactgcctcctccctggcccacccttccacgatgcccgggtccaccagggacatcaccttctcccggctctccagccgccgcgacacccagtccaccaggtcccggctctccaccaccgccggccgccccgtcaccagctccagcagcaccacgccgaagctgtacacgtcgctcttctccgtcaccttgcacgtgtacgcgtactccggcgccatgtaccccagcgtgccggccacgacgccggcggacgagtggccgccgccgccgcctgccgagctgaggatcttggcgagcccgaagtcggcgagccggggcttgaacgactcgtccaggaggatgttgctggacttgacgtcgcggtggaggatggggcggtcgcagccgtggtggaggtactcgaggcccctcgccgcgcccaccgccacgtcgtgccgctccacccacccgagcgcgcccatcttccgccccgccgccccgtgcagccgctcgtacaggctgccgttggggaggtgctcgtacaccagcaggctcgccgcgccgtccgcgctggtgatgctgcacagcagcttcaccacgttcacgtgccggatggcgctcagcgtccccacctccgagtcgaactcgcggcaccgcaccgacgccgccggccgcagcatggcggcggacggcgccgtgctcgtcgccaccccccgcgtgacgtgcttcacggccaccaccgcgccgttgccgagcttcacgcggtacacgttcccagacccgccgctgccgaccaggttctcgtcgcggacgccctcgatgatctcccgctcgtcgaacgccaggatccggaacgacttgaggtcccacgagcccttcttggcgaacagcttccccgcggaggcctccgcgcgccgccgccgccgcttctgcaggcacatggccacgcccgcccccgccagcagcaccgccgtgacggcgaggatgcacgtcacggccaggcgctccgcgttcgccgaccggctcccggagctccgaccgcagcggcggaggaagacagcgccgttggtggcacacagcccggggttcccgtcgaagctctcgccg

SEQ ID NO: 5326 - DNA, 1299 bp, Zea mays
  misc_feature (765)..(765): n = any nucleotide
atgagagctcttaactatggtgttgacatagtggtcggaacaccaggtcgagttattgaccttctgagaaggggtgttttaaacctttcacagatccagtttgtggtcctagatgaagctgatcaaatgctggctgtgggtttcgatgaagatgttgaggtgatcatggagcaattgccacagaatcgtcaaagcatgctgttctctgcaacaatgcctagttggataagaaaaatttcgaacaagtacttaaaggatccagttataattgaccttgttggtgactcagatcagaaattacctgaaggaatctctctctattccattgcctctgataacttcgggaagccttcaattattggtcccttgattaaagagcatgccaatggtggaaaatgcattgtgtttactcaaactaaacgggaagcagatagattggcatatgtcatgggaaggagttatcagtgccaggcactgcatggggatatttcacagaatcaaagagagaggacactttcaggatttcgtgatggtcgttttaatatccttgtggcaactgatgtcgcagctcgtggattggacatacccaacgttgatctagtggtacattatgagatcccaaatacatcggagttatttgttcacagatctgggagaactgcacgagcagggaagaaaggcagtgcaattctaatatacacgtatgaacagactagagctgtaagggtcatcgagcaagatataggatgcaggttcacagagctnccgaagatgccagtttcagacgaggctgcagacatgtttaatgtcatgagagatactcgctctagatcagttggaagcagaagaacaggtgaccttttagccgtgaaggttatggtgactttgaagaccatcgttccagaggcttcggtgattttgagagatttggtggttcctctgaccgcggcggtggattccgtgactcaggttcaaggtaccacggtggatctggaggtttcagacgatcttccagtgactttggcaggcctagcttcagtcgttctgatagatttggcgactttggagacagtgatttcagcagacgtggtaacgctgactttgggcgttcccggagctctgatgattcaggctcctcacgttatccaagaggctatggtggttctggcacgtcagattccggcaacttcggtggcttcaagggttccaagtgatgaatcggatagggttttcttgtacagttctgaaccttttctaacacctgttgtatgttccttccctgaccaaaccagtagcact

SEQ ID NO: 5327 - DNA, 315 bp, Zea mays
atgccacaacttaagcacaaacttgatattgtttcttccaatcctattagttgtgctaaaataaaaactttcaatcctataactagtgtgcaagatgagctgaaattgttatcttctttaaatactttgggctatattgaatttaatgttctatgtaatctaaataaattagaggagaaactttcttttagtgctgatttgccatggttatctaaacatacatatcatgttattggaagatataattggaaagcagaatatatggtacatcgagtatataattgttcaaatatgaaatctccttttgtcataaaa

SEQ ID NO: 5328 - DNA, 570 bp, Zea mays
atggagtcagtgacgacttttatggggcctctgaacgaagcgatcttggaggccaacgcattggtggagcggacgagctcgatctatgccaaccatctaaaagcagcagccggtagcctggccgctttggcatggattggttacaccggcaaaggctgcggtatgcctcttccgattgctcatgtagaagagagctggcaaatggcagagttctacagcaataaggtacttgtggaatacaaaaataaggaccctgatcatgtggagtgggcaaaagccctaaaagagctgtacattcccaatttacgtgactacgtgaagaggtattacccattgggtccttcgtggcaaccgccaggaagcgcagccaacaaggcaccttcagctccgtctgttcctcctccatgtctttccatctcttcagcctcgtcgtcgcaaccaaaatctggaatgtcagctgtctttgctgaaatcagctctgggaaaccagtgacacaaggcctcaagaaggtaactgatggcatgaagaagcaaaaaatagacccggccagaaccgggtgttgtggctgc

SEQ ID NO: 5329 - DNA, 264 bp, Zea mays
atgaggctgtggacgcggccgaccgcgtcgccggaggccgaggaggaggaggacggcgaggcgcacgccgcggcgcaggcgcagggccgcacgtgcgcgcagttggggcagagccggaggaggcggtcccggaggcagtgggggcacaccccgccgccggatctcgcggcagggtgcttccggcacctccattcgtcgcctcctccgccgccgacgacgaccgcggccaccgctgccttcatcgactcacgcggttgctcctcc

SEQ ID NO: 5330 - DNA, 195 bp, Zea mays
atggccgaggccgcaatgctgtggatagtgccttgcgctggttccccatacgagcacatacttcacgtccttgagcaaacttctatggatatgattgcagaagtcctccaccgtgcagccacctctgtcggtggaaagaacaacggggtctgtgaaatcaggctgctggccctgtggctttgtatacaccctcac

SEQ ID NO: 5331 - DNA, 351 bp, Zea mays
atggctgcagcgattgacaaaattaaggaaaaggcaaaactggatgttgtgccagtttttattacagttgatcctgaaagagatactgttgagcaggttcgggactatgttaaagagttccatccagatctagtaggcctcacgggcacgacagatgaagtaagacaagttgcacgtgcttatcgagtttactatatgaagacagaggaggagggttctgactaccttgttgatcactcaattgtcatgtacctgatggacccagagatgaagtttgtcaagttttatggcaagaactacgacacagattcccttgctgacggtatcgttaaagaaattaaagagcacaag

SEQ ID NO: 5332 - DNA, 768 bp, Zea mays
atggcgcccagcagcagcatagcagtactgctgctcctcgtcgtcgccgtcgtcctctccaacgtcccctcctcgggcgccctggcctcctcgtcgtcgtctctgctgcaccagtcgtctccgtctgagagtgagactgagaccgacagtagcagcggagaatctacttcgtcgtcgtcgtcggaagaggccggcgagaaggagaaggagaaggagcaggagatggagaaggcggtcgcggcggagaaggctgcccagcaggagctgctcaagtacgccaaggagaagggcatcgtgtcaccgaccaacggcacggggtggtacaagggcatcgcccgggagttcgtggacgcccacaacgagctccgcgcgcgctacggcgtgccgcccatgaagtgggacaggaagctggcgcggcaggcgcggcgctggtccaaccgcatgcgcaaggactgcgagctcgtccacagcggccacaagtacggcgagagcctgttcaggagccacgacgactggaacgccaccgccaaggaggccgtcttctggtggggcaaggaggagtccatctacgacagggacacggagcagtgcacaggcggcagggcgtacaaggagtgcggccacttcgcgctcatggtcggcaagaggagcaccaaggtgggatgcgcacgagcagagtgcttcaagggaggcgtcttcatcacatgcaactactatgccacggacctcaagaagaagaacaagaagaagaagaagagcaccaccaac

SEQ ID NO: 5333 - DNA, 549 bp, Zea mays
  misc_feature (95)..(95): n = any nucleotide
atgagctccgcgtcgccaacgagtacctcgcccgccgcatcaacgtggtcggcggcaggctcgccgacgagttcagcggtctccgcctcgccganggagcacaccacgccacctcctctgtcaccgctgcccgccgcgccggtgatgccgaagagcatctccgttcgctcgcccggctatctcaagatggtccagaacggcaagcatcgggcgtccaagccaatgaagggctcgcagcgcgtgttagtgggcatggaaggcggagtgaaggaggaggagaagctcaacggcgggctgcagttcgaggtgtacaaccagggcatgctgaagacagagctctgcaacaagtgggaggagaccggcacgtgcccgtacggtaatcagtgccagttcgcgcacggcatcgccgagctccgccctgttatccgccatccgcgctacaagaccgaggtctgccgcatggttctcgctggcgttgtctgcccctatggccaccgctgccacttccgccactccatcacccctgccgatctcttcctcccgcgccct

SEQ ID NO: 5334 - DNA, 444 bp, Zea mays
atgcacgcgaggctgcggtcgtgcggcggtctggtcgtctgccccgagggcaccacctgccgcgagccgtacctgctgcggttcagcccgctgttcgccgagctcgggcacgacgtggcgcccgtggcgctgcactcgtcggtcggcatgttccacggcaccacggcggccgggtggaaggcgctggacccactgttcctgctcatgaaccccacgccggcgtacatcgtgcacttcttggacaccgtcgacgtcgagtgcggcggcccggaggcggcgcgcgccgtggcgaacgagctgcagcggcgcatcgcggaggcgctcgggtacacgtgcacggggctcacgaggaaggacaagtacctcatgctcgccggcaacgaaggaatcgtcgacgtcagccacggcggcggtggcgccaagaagagaactacttgtgctacc

SEQ ID NO: 5335 - DNA, 591 bp, Zea mays
atggccgtggcgctcctcctcctgctggtgacgcccgtcgggctgctcgccgcgctcgcgctcctcacgcggccccgggccgcgcgggtcccgctcaaaggccgccacgtcttcatcacgggcgggtccagcggcatcgggctcgccatggccacggccgcggcgcgggagggcgcgcgggtctccatcctggcccgcaacctcgcccgcctcgaggacgcgcgcgccgccatccagcgcgactcgggcagggacgacgtcggcgtccacgcggccgacgtgcgggacgccggcgccgtcgcgcgcgcgctccaggaggccggccccgtcgacgtcctcgtctgcaaccacggcgtgttcgtgccgcaggagctcgaggggcaggacgtggatgacatcaagtggatggtggacatcaactcaatgggcagcttccactcaatcaaggccgcgcttccggccatgaagccgcgcacccgcgagacgcgcctccctgggctccatcgccatcatgtcctcccagccggccaaggttggtatttatggttacactgcctactcagcgagcaagttcgctcttcgcggattggg

SEQ ID NO: 5336 - DNA, 192 bp, Zea mays
atgctagcaaatgagccgtgcaggtccaagagcgtcaacgaccagtcgtcactgtcgccggcgcacgacagtcatggtgattacaatgatatcgctgaggaggacgaagacgagtgggaggacggcaggaggaagtttggggcggcagatacatttaagattcctgacgagattgacattgctcatttcagt

SEQ ID NO: 5337 - DNA, 651 bp, Zea mays
atgttgtctgctgcatttttattgtcaccaatgggtgtgcacaacacaagcaggagcccaggcctacgacgagtacgggcgcgacgactacagcagcaggacgaagaacgggagcggcggcgcggacaagggcgggccgacgctgtcgaagctggggtccaactcgacggcgcagctgtaccccaaggacgacggcgaggggagggcggcggcggtggcgatgccgccggcgagcgtgatgacgcggctcatcctcatcatggtgtggaggaagctgatccggaaccccaacacctactccagcctcatcggcgtcgtctggtccctggtctcctacaggtggggcatcgagatgccagcgatcatcgcccggtcgatttcgatcctgtcggacgcgggtctcgggatggccatgttcagcctaggcctgttcatggcgctgcagccgaggatcatcgcgtgcgggaacaagctggcggccatcgcgatgggcgtccggttcgtcgcaggccccgccggtcatggccgccgcccccatcgccgtcggtctgcgcggcgtcctcctccacatcgccatcgtccaggctgctctgcctcaggggatcgtgccgttcgtgttcgccaaggagtacggcgttcatcccgacatcc

SEQ ID NO: 5338 - DNA, 240 bp, Zea mays
atgctccagttgctggtgttggaaaggtgtttttggaatatgcagatgtcgagggctcgaccaaagcaaagacggggatgcatgggcggaaatttggcgggaaccaggtggtggccgtgttctatcccgaggacaagttcgctgctgagcagtatgactgaaagttgtagaacctgttctagagttgcaacacacaatgtgtgtgttttttttaaaatctttgagggtaccgttttctct

SEQ ID NO: 5339 - DNA, 846 bp, Zea mays
  misc_feature (345)..(345): n = any nucleotide
atgacctcgatcgccaatccgtacttatgcacacgagcatttcccacgaggccacgaccttcgcccgctcgatcgcgcgcgcgcgctcgaggggacgggcatcatctcccttcggcgtcgcgctgcaggagcctgatcacctcgtcgggcgggacgtcgcgccacacccggggccgcgcggcgccgtggccgagcttggcgaagccgtgcgccacccggttacccccgcgccgcacgtgcgagacgctcatgtcgtcgagcagcagcagcagcttctcgatctccccgaacaggcgcaggtcctccggggcccgtacccgcacgcgcgcgcggctccgcacgggntcgaccaccgccatggcgtcgccctcgacccagacgctgcgccagccgttggccaccgcgagctccagcccgcgccgggagcgccgcgagctccgccacggagctggtcgcggcgccgatccgctccgcgtagcccagcacgaacccgccctcgtggtcgcggtacacgccgccgatgctcgcgcgccgggacgcgtgcctcgacgacccgtcgaagttgagcttcagtcgcccgggctccggcttcctccacgtgctcgccgacggctccggtcgcgacggcccgttgttatcacccccgcgcagcccccggcgcccgcccggcgccgcccttccgccgccgacgaggcaggccgacaaagggtggcacagcagcatgctgccagtgacaagaggacggtgcacccgcagcatcgttccccggcgtcaaactgctgcgcggcgaactttgatgcgcatttagcgcccgtgcacgcactttgcttgaagcgatcgctcgcc

SEQ ID NO: 5340 - DNA, 189 bp, Zea mays
atgtccgtcaacttcgttgacctcgacgccgccgcgcccggggacgccctccgcatcaccgccagggcgctcggccacaagggcgcctactccggcacgcacgtcatcgtcgccaacgccgccacggggctggtggtcgccgaggggaggcactcgctcttcggcaagatgaagatcaggagcaacatc

SEQ ID NO: 5341 - DNA, 252 bp, Zea mays
atgttccgggaggagtacgaacgtcgtagcagacagctccgcgagctctgccgcgctgtccgcgtcgacaccgtagccgagctccaggagttgctctgcgccatggtactcgccgagtgcgtctacaagagacctgtttctgagatgatgagatatatcaacaagtttacgtctgattttggtggaaatgttgtgtccctggagcgtgttcaaccatccttggatcatgtaccacatcggttaccaaaaagc

SEQ ID NO: 5342 - DNA, 918 bp, Zea mays
atggacggcggaggaggaggcggtggaggaggaggtggagttggggcaggtgtcatggtgggtggcggagtcgtgccgggcggcgggggcggcgacgtggaactcgtcagcaagacgctgcagttcgagcacaagctgttctactttgatctgaaggagaacccgcgggggaggtacctcaagatctccgagaagacatcggccacgcgctccaccatcatcgtccccatcgacggcgtcgcctggttcctcgacctcttcgactactacatccgcaccgacgagcgcgacgtcttcagcaaggagctgcgactccagaccaaggtgttctatttcgatatcggggagaacaagaggggccgattcctcaaggtttctgaggcctctgtcaacagaaaccggagtaccataattgttccagctggcagctctggtgaagagggctgggaagcattcagaaatgtactgttggaaataaataacgaggcttccagattgtatgtcctaccaaatcatccaaatcagcaacacatggagccgccagagcgtcttcctggcttgtcagatgatgtgggtgccggatttatagctggacatggtagccagtccgcttctgggccagaggtagatgtcgaacgtttggttgatctgcctcctcaagaagaaattagtggcatgggtatgtctaaggtgattagggcagatcagaagaggttcttcttcgacctgggaagcaacaacaggggccattatttgaggatttctgaggtggctggagttgatcgttcgtctataatcttgccgctctcgggtttgaagcagttccatgaaatggttggtcactttgtagatataatgaaggacaggcttgaaggaatgacaggagctaacgtgcgcactgtcgaatccagtcagaga

SEQ ID NO: 5343 - DNA, 450 bp, Zea mays
atgcctacgacgatggcggcggcggcggcagcgtctgctccaagctcgctccgcgtttcgcgccaggggacgatcgggggaggccatgtcctctacagcaggtctcagagggctgccactgtctccgccagagcttccatgaacataacgtgctgcgcgaaccagacgcagacggcgcagcgcaagtcgtattcggggacgacctctccgccgtcaggttcagtgaaagagaaggtgaagccgaggctcgacgacgggggcgtcgggtttccgccgttccggttcgggggaggcggaggaggaggcggcggcggcggcagcagctcgtccggcgggttcatcctcttcgtggtcgtcctgctcctggattacctcaaggagttcgagaggaacctgcagaacgggccacggaggagcggcggtggctacgacgacgggctggcgccacag

SEQ ID NO: 5344 - DNA, 162 bp, Zea mays
atgaaccgagggcccggcgccgatacctccgccagggtgccgtggccgggataccacgtgctcaacgactccgccgacgccgccaacttcaccgcgctcgacttcatccagggagacatctggctcaacgccacctcattcccctacacgctgggatttacg

SEQ ID NO: 5345 - DNA, 426 bp, Zea mays
atgggtcgcgtccgcaccaagaccgtgaagaagacctccaggcaggtgatcgagaagtactactcccgcatgaccctcgacttccacaccaacaagaaggtgctggaagaggtctcgatcctcccctcgaagcgcctccgcaacaaggttgccggcttcaccacccacctgatgcgccgcatccagcggggccccgtccgtggcatctcgctcaagctgcaggaggaggagcgggagcgccgcatggacttcgtcccggagaagtcagcgctcgaggtcgaagagatccgcgtcgacaaggagaccatggagatgctcgcggcacttggcatggccgatctcccgggcgtagagcgccaggctgaggttttcagggtccccgcctacggccgcccccagtatggaggtcccccccgtgaccgggtt

SEQ ID NO: 5346 - DNA, 963 bp, Zea mays
atggcgcgcctgctcctcttcccatcccaagcgtgcgtcgatcctggccgccacctcctcctccacccgccggtctccaggccccgtgctgtccggtctgggcctcctcccgccgcgccacgccgcaccggggtcgtctctcttcccggccgttgcccaccgcccctttgctggaaccaccatccatttcttccttgcagatcatcaaagagaggatgggtcgtttttgcttcagaaaacgtacaagaaatttcttctcaccttcctcgcaaggatgaaaggagaagtgggaatttgcttctgcgattcagtgcactcccatattgcactatggcttggttgagcactgctcaattagcacaatctagtgttggggaaaagctaaatatggtttatgaggtcggggagctgtttgagctgggaattcagctgtcttatctgctcatacttattggactgcttggagctggtacattttttgttatccgtcaggttcttgttcgtagggagcttgatctttctgccaaagagttgcaagaacaagtgagaagcggtgatgcaagtgctactgagtattttgagcttggagcagtcatgctacggagaaaattttatccagctgctatcaaatatctgcagcaagcaattgacaaatgggacagagacgagcaagatcttgcgcaggtctacaatgccctgggggtcagctacaagcgagagaacaaacttgacaaggcgattcagcagtttcagaaggccgtggagctccagccaggctatgtgacagcttggaacaacctgggtgacgcatatgagcagcagaaggacctgaaatcggctctcaaggccttcgaggaggtcctcctctttgatcccaacaacaaggttgcaaggccacgcgtcgatgacctcaggccgcgcgtgagcatgtacaagggtgtgcctgtaaaatccgaaaagcga

SEQ ID NO: 5347 - DNA, 351 bp, Zea mays
atgcctggatcagttggcctcagagactgcaaagcgctcgagaagatggtcaagacccacgccgaggatgggggcctctacggcgccatctgtgctgcgccggcggtgacgctggcttactggggcatgctcaaaggcttaaaggcgacatgttatccgtcgttcatggagaagttcactgcagaggtgatccctgtggacctcgagggtcgtggtcgacagaaatgcgatcaccagccagggtccaggaaccgcagtcgagtttgctcttgctttggtggagaagctgtatggcaaagagaagatggaggaggttgctggacctttgtacttgcgtcctcaacatggagt

SEQ ID NO: 5348 - DNA, 399 bp, Zea mays
atgctctcatccgccttttcatccactgcctccaccgagagggtttcgcagtcgccggcggagcccgaggcggtgctcatgacggaaggttgcgtccggagattaaaagaattacatgctaaagaaccatcctctgaaggtaagatgctgcgcttaagcgttgaagctggtggatgttctgggtttcaatattctttcgctcttgatgacaagaaaaactcagatgatagggtttttgagactgatggtgttaaattggtcgtggatgacatctcatatgactttgtaaaaggtgccactgtggattatgaggaggaacttatacgttcagcgttcgtggtttcaacaaatcctagtgctgttgggggctgcagctgcaagagttctttcatggtgaaa

SEQ ID NO: 5349 - DNA, 471 bp, Zea mays
atgtcgacggccgggagcggcagccttcgcccggccgtggtggaggacacgggcagacactgggcgccgcacggacctgtgctgacggcctgcgtcgtggccatcaacgtgctcatgatcctcctcgtcttcgtcttcttctggcgctacttctccggtaaacggggaccatccgcgtcatccggcggcggcgacggcgacgacgacgacgcgtcgtcatccgcgtcgctgcccgtggcctccccatgggcatggtcgtcccgccggcggagcagcaaggaccacggcccgcagccggtggacgacgacgtggcgtcggcgctgcccgtgtacgtgtactccagcagcgccggcggcgaaggcgggaaggccccggagtgcgcggtgtgcatcctggagctccgcgacggcgactcggcgcgcctcctcccgcgctgcgggcaccggttccacgccgactgcgtgggcgcg

SEQ ID NO: 5350 - DNA, 102 bp, Zea mays
atgccagatttgaacaaaaacatcatttatctggcaacccacttatttcgagctccttccatagcctcttctcgcacccttgtcaattcatctcaaccaaac

SEQ ID NO: 5351 - DNA, 525 bp, Zea mays
atggaggcgctgtttgggtgcaacaaacatggcggggacaaggccgctgatttggcctcgtttataatcgtgcaggctgccttggaggtgccaaggttacttgggctccttgccatgattcttcataatgaaatctttacatctggtggagatcagaatttgattaataggattctgagcaaaaacaaaaatgcaactgatttcgagaacaaggatgatggagagtctgatgatgataatgatgaggagggagacgatgaggatgctgaaaaccaagaagatgatggtggtgatgagggatcagatgacaatgggaatgaggaggaagatgacgacgacgatgataacgatcctgcagccaacggtgaaggaggaagtgacgacgatgatgatggtggagaggatgaagaggaggatgatgacgacgatgatgatggggatggtgacaatgaggaagatgaggaggaagaagaggaagaggatgatgacgatgatgtcccccaaccacctactaagaagaggaaa

SEQ ID NO: 5352 - DNA, 600 bp, Zea mays
atgctcctctccggcccggccgtcagccgcgacgcgggcgcgctcttcgccggccaccacgtcgcggcgccgctcttcgcccagtaccacccctacgcgtcggccgccacgctctccgcctccgcgccgttcccgacgatcaccctcgacctcacgcactcgccgccgccgccggccgcgggcctgctccagcaccgtctgcccacgccgcccgtcccggccatgccgttcccgatgccgtacggcttccctggtgctggtgggcacaggctggcggcggcgccggtgccagccccacacccaccggccggcgcgacgctgctgggtttggacggaaggaaccggtcggcactggacaccatgacggccgcgatcgccagcgaccccaactttaccacggcgctggcggccacgctctcgacgatcatggccggagccggaggcgctgagccacaagctcctcacctaagcggcgccgctgacgcctccggagatggtggtaacggtagcgccggcactgggcccgccacggctgcggctgccggagcacgtgagactgcattgcatgcgcttttgcaaaggcttaatgacagcaggcaa

SEQ ID NO: 5353 - DNA, 831 bp, Zea mays
atggcggcggacggcggcggcggggtggactgggagagcctggcggaggccacctccggggcaatcggctcgctcgtcagcaccaccgtgctctacccgctcgacacctgcaagaccaagttccaggccgagctccagacgcaccagggcgctcagaagtataggaacctttcagatgtcttttgggaagcgattcgtaaaaagcaatttttgtccctatatcagggcctgaacacgaagaacattcagtcttttgtctcctcgtttttttatttttatgggtatagctattttaaaagactctacttggagaagagtggagcaaagtctattggaacaacagccaacttgttagttgctgctgctgctggtgcttgtactgttatcgtgacacagccattagatacagcagcttctaggatgcagacaagtgtctttggaaagtctaaagggctgagagaaactcttgcagaaggtacttggatggaagcattcgatggcttaggcatttccattatattgacttgcaatccttctattcagtacaccgcgtttgatcagttcaagcaaaggatacttcataggcagcggcgcaaaaatgcaggatcagcggaggataattccggagttgctctttatgctttctcagcttttctgcttggcgccgcctctaaaagtattgctacagcattgacttatccattaatcagatgcacggtgatgattcacgtcgccgaccctgacgaggatgatgacaaccaacctgtaacgtcacctcaattatcaccccccaatacagtgctctgggccctcgttagcgccctgcgattt

SEQ ID NO: 5354 - DNA, 366 bp, Zea mays
atgaccagagcattgtggatattgatccaaaagcagagctgctcctcgtgcgtcatcttcaccgggtcgactttctccaggcgctgtatcagagacctggtagtctcgagcatcttcgacgcgtactcaaacgtgtcagcgtcgacgcgtatcctcggaacgacgaccatcatcacgcctgggctctgctcaccgctctccttctcgactccacacggccgcgggctccagctatcgaagttgttgcaccgagaccgagggctccagctatcgttccggcgcctcggagagaaggtgctccaagacgagaccgaagggctcggcgaagccacgcagcactccccctccgcgcccgagagcttgcag

SEQ ID NO: 5355 - DNA, 426 bp, Zea mays
atgaaggaggcgtctctttccgccagggaggtgcagatagatgagatgagggcggacgtgttcaggaacctgctgcacttcatctacaccgacgcgctgcccaagtccgagccccaggaagaagaggcccttatggctcagcacctgctcgtcgccgccgacaggtatggcatggagaggctcaaactcgtctgcgaggacatcttgtgcaggcacatcgacgtcagtaccgcggccaccacgctggcccttgctgagcagcaccaatgccaggggctcaaggaagcatgctttcagttcctcaagaagtctcctgggtcgctgaatgatgtcatggcaactgatggatttgaccatctggccaacagctgcccgtccattataaaggagttgatgtctagacttgctgctgcccattattccaac

SEQ ID NO: 5356 - DNA, 291 bp, Zea mays
atgggtcgtcctacttctaccagcctggtgaaattgccggtcgtagaagttcaactgaactggctcatgtatggaacaaggcggtggacgagactcttgggaaacttgttgtgtaccttagctctcgtggatggtgatccaagcaccatgtcgaacatggcaactgaggaggcacgggtggaggaagactcttttttgaagccactgatgtgctcatatttctctgtatccggattgagcatgttttgttttaaaagaaaagatgctcccagtgaccgatttatctcgaac

SEQ ID NO: 5357 - DNA, 420 bp, Zea mays
atgcggaatgcccttttgtcaactgcaacaagtggtgatcaggatgaaagtagtcaggcaaaagataaaatctcggtaacatttgtcaacaaggatggctcagaaaagacaatatgtgttccagttggaatgtccatgttagaagctgctcatgaaaacgacatagagcttgaaggagcatgtgagggctcacttgcgtgttctacttgtcatgtaatagtaatggatgtaaaatattataacaagttagaagatccagcagatgaagaaaacgatatgcttgaccttgcatttgggctcacagaaacatcacgccttggctgccaagtgatcgcgaagcctgagcttgatggcatgcggctggcgctacctgtagccacaagaaacttcgcagtagatggctatgtaccgaaaccacac

SEQ ID NO: 5358 - DNA, 669 bp, Zea mays
atgaaggctttgggcatctcgaggccgtttcccttgtcgcaggttgactcccccgccggtgtcggccacctttgtcccctccccaatggtttgagacctcggggttcttggagtagaaaggtccagtgtcccatttcatccatgtccaaatgcttttcccaccatgcaagattctcacgttacattgtctatttcaaccttggatctcaaacgatatcttttaaagcaggcgacgaggtcgtccacctcggcggcgtcaacgtctgcgagtacctcctgcgggtgcgggtgcccctcgggggcctcaccggtctccggcgcggatcctgtgcggtcgagcatctgggaccgcggcgggggccggtagaggaagaggtcgtagaggaacctgccctgcggcgtgagcagcgcggcgtaggcgggcgccgcggggccccgcgcgggcgcgttcggcgtgggcgcgtaccgctgcggcgacgacgcgccggccgcggagaaggcggagaggaggtcgttggtgagcagcgagtggaggaagcgcgccgcctcgggccccgcgaagcggaccacggcgcgggacgccaggcggcaggccagcacccccgggccgcggcgcggggccggggtcgtgtggagggcgcgcgcgccgcgcggcagcggctggaggag

SEQ ID NO: 5359 - DNA, 444 bp, Zea mays
atgttgccctggttcgagttggcgttatcgacgcggagcagcgagacagcgttgccgtggtcgcggccgttggcaatgtgggccatctcctgcacgtcgccgccgttggagagcatgtcccactcgctgcgggtggcgtcgtcccggaggaagccgaagacgcgcgcgggggccacggggagccagaaggaggtggcggcgttgaggatgatgcccggcggccggcccgggtcgtccacgctcttgcgcgtcatcacgcgcacgtcctccgcgccgctgcccgacagcgtggtccactggtgcgtcgtcgacgccgtcacgccgccgcagaagctcgccaccatgcgctccgccagccgcatcatgctgcggcgcccctctggcgacgtcaccacgcccgcgactgtccctgctgcttccgcccaatctaacgacacgctggcc

SEQ ID NO: 5360 - DNA, 231 bp, Zea mays
atgcacatggacttaaacccctcagaaagtgctctgagacaaccaccattgcaccaccgcatagcgccatcaccaccaccaccaccaccaccgccgaaaatcaccatcagtaaagttttagcaagattccccttactctcaagtagctacattacagcactcataagaggaagaataagacgcgtacccacaagaaatgcctccgaggactacgacagcaacgtaaaagcc

SEQ ID NO: 5361 - DNA, 318 bp, Zea mays
atggccggcgggcttgaggatccgcgcggcctcggcggcgaggtcggccgggcgcttggcggcgtcgagggcgcgccccgcgaagacgaagtcggcggacgacgagccgaacggcagtctccggtcgccccccgcgacgacgagcggcggcgcacgcctcctgccgacggcgacggctttggcgacgccgagctcccgcatcgcgagcgccccctgcgggccgcccaggcagacttttcttttctgcgggcgagagggcgccgaacgatgatgcgcggcgcgagggcggccgcgtggacaacgaccgcccagccattg

SEQ ID NO: 5362 - DNA, 501 bp, Zea mays
  misc_feature (500)..(500): n = any nucleotide
atggttgaattaagagcttttcaagaaacatctgatgcatcacagcgatctgctgcaaccttgccattgtccccatcatctggcgattcttttcctggaggaaaagatgaggtttcggttattaaagcagggttgaggaaggtaaaaattctcacagatctggtgtcgacacgaaggcctaagaagacttgccaggcaggtggcgaagataagttttgtgttaacagtgatggtgctgaatatccatgtgatactgagtctcttgatgacgatctagatgacagagtagaggaagatgaatttggagattcaactatcaggaagtctttcagttatgggtctctgcaatctgtcaactatgttggtggcctagtttatgcccatgcaaagattgatggggagcatgaggactggatatattatagtcacccgaaaactgatgtcggtttccaagtagagaaagtattggcatcaaccacagagaatgggttgctaactgnc

SEQ ID NO: 5363 - DNA, 558 bp, Zea mays
atgaggatgtgcggctgcgtcgccggcgctgcagcagaagctgccgctgctgttctcgtcctcctcctcctcctcctccggcgccgggcacgcggcggcgggctcggcggagaggcggacgcccgtgagcaggaaccgggcgtggcgcatggtcaggtcgctggcggtgtgcaccgacacgtcgcagtcgcggcacaggatggcgcggtcctccttgcagaacaggagcccccgcttgtcctggcagatgtcgcaaagcggcggcggcggcggtggctccgggctgagcagcgagaagcggcggtgcttgccggcgagcttgttgggcgcgggcacgccggcggtcgctcgccgtcgtacagcgcccctcttcgtgggcgcattttgatccccgaaggccgccttcggccgccgctcaccgtcgcaactgcacccttcattcttcggcccactccactcctgcctttccccctcacggcggatgtctcgcgccgcgcttcctgtccgggtcctgtcttacgggccttcggccctccccaggccctctcgctcctactt

SEQ ID NO: 5364 - DNA, 1464 bp, Zea mays
  misc_feature (25)..(25): n = any nucleotide
  misc_feature (43)..(44): n = any nucleotide
  misc_feature (267)..(267): n = any nucleotide
  misc_feature (270)..(270): n = any nucleotide
  misc_feature (330)..(330): n = any nucleotide
  misc_feature (380)..(380): n = any nucleotide
  misc_feature (405)..(405): n = any nucleotide
  misc_feature (411)..(411): n = any nucleotide
  misc_feature (433)..(433): n = any nucleotide
  misc_feature (436)..(436): n = any nucleotide
  misc_feature (440)..(440): n = any nucleotide
  misc_feature (442)..(442): n = any nucleotide
  misc_feature (451)..(451): n = any nucleotide
  misc_feature (453)..(453): n = any nucleotide
  misc_feature (455)..(455): n = any nucleotide
  misc_feature (462)..(462): n = any nucleotide
  misc_feature (471)..(471): n = any nucleotide
  misc_feature (477)..(477): n = any nucleotide
  misc_feature (479)..(479): n = any nucleotide
  misc_feature (481)..(481): n = any nucleotide
  misc_feature (483)..(483): n = any nucleotide
  misc_feature (522)..(522): n = any nucleotide
  misc_feature (524)..(524): n = any nucleotide
  misc_feature (528)..(528): n = any nucleotide
  misc_feature (532)..(532): n = any nucleotide
  misc_feature (534)..(534): n = any nucleotide
  misc_feature (536)..(536): n = any nucleotide
  misc_feature (538)..(538): n = any nucleotide
  misc_feature (551)..(551): n = any nucleotide
  misc_feature (553)..(553): n = any nucleotide
  misc_feature (555)..(555): n = any nucleotide
  misc_feature (557)..(557): n = any nucleotide
  misc_feature (559)..(559): n = any nucleotide
  misc_feature (561)..(561): n = any nucleotide
  misc_feature (564)..(564): n = any nucleotide
  misc_feature (583)..(583): n = any nucleotide
  misc_feature (585)..(585): n = any nucleotide
  misc_feature (587)..(587): n = any nucleotide
  misc_feature (589)..(589): n = any nucleotide
  misc_feature (591)..(591): n = any nucleotide
  misc_feature (593)..(593): n = any nucleotide
  misc_feature (595)..(595): n = any nucleotide
  misc_feature (597)..(597): n = any nucleotide
  misc_feature (599)..(599): n = any nucleotide
  misc_feature (601)..(601): n = any nucleotide
  misc_feature (603)..(603): n = any nucleotide
  misc_feature (610)..(610): n = any nucleotide
  misc_feature (612)..(612): n = any nucleotide
  misc_feature (614)..(614): n = any nucleotide
  misc_feature (616)..(616): n = any nucleotide
  misc_feature (618)..(618): n = any nucleotide
  misc_feature (621)..(621): n = any nucleotide
  misc_feature (623)..(623): n = any nucleotide
  misc_feature (625)..(625): n = any nucleotide
  misc_feature (627)..(627): n = any nucleotide
  misc_feature (629)..(629): n = any nucleotide
  misc_feature (679)..(679): n = any nucleotide
  misc_feature (691)..(691): n = any nucleotide
  misc_feature (693)..(693): n = any nucleotide
  misc_feature (695)..(695): n = any nucleotide
  misc_feature (697)..(697): n = any nucleotide
  misc_feature (701)..(701): n = any nucleotide
  misc_feature (703)..(703): n = any nucleotide
  misc_feature (705)..(705): n = any nucleotide
  misc_feature (707)..(707): n = any nucleotide
  misc_feature (709)..(709): n = any nucleotide
  misc_feature (711)..(711): n = any nucleotide
  misc_feature (723)..(723): n = any nucleotide
  misc_feature (731)..(731): n = any nucleotide
  misc_feature (733)..(733): n = any nucleotide
  misc_feature (735)..(735): n = any nucleotide
  misc_feature (745)..(745): n = any nucleotide
  misc_feature (747)..(747): n = any nucleotide
  misc_feature (749)..(749): n = any nucleotide
  misc_feature (751)..(751): n = any nucleotide
  misc_feature (753)..(753): n = any nucleotide
  misc_feature (755)..(755): n = any nucleotide
  misc_feature (757)..(757): n = any nucleotide
  misc_feature (759)..(759): n = any nucleotide
  misc_feature (761)..(761): n = any nucleotide
  misc_feature (765)..(765): n = any nucleotide
  misc_feature (779)..(779): n = any nucleotide
  misc_feature (795)..(795): n = any nucleotide
  misc_feature (797)..(797): n = any nucleotide
  misc_feature (799)..(799): n = any nucleotide
  misc_feature (801)..(801): n = any nucleotide
  misc_feature (803)..(803): n = any nucleotide
  misc_feature (805)..(805): n = any nucleotide
  misc_feature (807)..(807): n = any nucleotide
  misc_feature (809)..(809): n = any nucleotide
  misc_feature (811)..(811): n = any nucleotide
  misc_feature (813)..(813): n = any nucleotide
  misc_feature (817)..(817): n = any nucleotide
  misc_feature (821)..(821): n = any nucleotide
  misc_feature (841)..(841): n = any nucleotide
  misc_feature (845)..(845): n = any nucleotide
  misc_feature (854)..(854): n = any nucleotide
  misc_feature (858)..(858): n = any nucleotide
  misc_feature (860)..(860): n = any nucleotide
  misc_feature (862)..(862): n = any nucleotide
  misc_feature (864)..(864): n = any nucleotide
  misc_feature (866)..(866): n = any nucleotide
  misc_feature (868)..(868): n = any nucleotide
  misc_feature (874)..(874): n = any nucleotide
  misc_feature (876)..(876): n = any nucleotide
  misc_feature (878)..(878): n = any nucleotide
  misc_feature (880)..(880): n = any nucleotide
  misc_feature (882)..(882): n = any nucleotide
  misc_feature (884)..(884): n = any nucleotide
  misc_feature (886)..(886): n = any nucleotide
  misc_feature (888)..(888): n = any nucleotide
  misc_feature (890)..(890): n = any nucleotide
  misc_feature (892)..(892): n = any nucleotide
  misc_feature (894)..(894): n = any nucleotide
  misc_feature (896)..(896): n = any nucleotide
  misc_feature (898)..(898): n = any nucleotide
  misc_feature (900)..(900): n = any nucleotide
  misc_feature (904)..(904): n = any nucleotide
  misc_feature (906)..(906): n = any nucleotide
  misc_feature (908)..(908): n = any nucleotide
  misc_feature (910)..(910): n = any nucleotide
  misc_feature (912)..(912): n = any nucleotide
  misc_feature (914)..(914): n = any nucleotide
  misc_feature (916)..(916): n = any nucleotide
  misc_feature (918)..(918): n = any nucleotide
  misc_feature (920)..(920): n = any nucleotide
  misc_feature (922)..(922): n = any nucleotide
  misc_feature (924)..(924): n = any nucleotide
  misc_feature (926)..(926): n = any nucleotide
  misc_feature (928)..(928): n = any nucleotide
  misc_feature (930)..(930): n = any nucleotide
  misc_feature (932)..(932): n = any nucleotide
  misc_feature (934)..(934): n = any nucleotide
  misc_feature (938)..(938): n = any nucleotide
  misc_feature (940)..(940): n = any nucleotide
  misc_feature (942)..(942): n = any nucleotide
  misc_feature (946)..(946): n = any nucleotide
  misc_feature (948)..(948): n = any nucleotide
  misc_feature (950)..(950): n = any nucleotide
  misc_feature (952)..(952): n = any nucleotide
  misc_feature (954)..(954): n = any nucleotide
  misc_feature (956)..(956): n = any nucleotide
  misc_feature (958)..(958): n = any nucleotide
  misc_feature (960)..(960): n = any nucleotide
  misc_feature (962)..(962): n = any nucleotide
  misc_feature (964)..(964): n = any nucleotide
  misc_feature (966)..(966): n = any nucleotide
  misc_feature (970)..(970): n = any nucleotide
  misc_feature (984)..(984): n = any nucleotide
  misc_feature (986)..(986): n = any nucleotide
  misc_feature (988)..(988): n = any nucleotide
  misc_feature (990)..(990): n = any nucleotide
  misc_feature (992)..(992): n = any nucleotide
  misc_feature (994)..(994): n = any nucleotide
  misc_feature (1002)..(1002): n = any nucleotide
  misc_feature (1004)..(1004): n = any nucleotide
  misc_feature (1006)..(1006): n = any nucleotide
  misc_feature (1008)..(1008): n = any nucleotide
  misc_feature (1010)..(1010): n = any nucleotide
  misc_feature (1012)..(1012): n = any nucleotide
  misc_feature (1016)..(1016): n = any nucleotide
  misc_feature (1018)..(1018): n = any nucleotide
  misc_feature (1020)..(1020): n = any nucleotide
  misc_feature (1022)..(1022): n = any nucleotide
  misc_feature (1029)..(1029): n = any nucleotide
  misc_feature (1031)..(1031): n = any nucleotide
  misc_feature (1033)..(1033): n = any nucleotide
  misc_feature (1035)..(1035): n = any nucleotide
  misc_feature (1037)..(1037): n = any nucleotide
  misc_feature (1039)..(1039): n = any nucleotide
  misc_feature (1043)..(1043): n = any nucleotide
  misc_feature (1045)..(1045): n = any nucleotide
  misc_feature (1068)..(1068): n = any nucleotide
  misc_feature (1070)..(1070): n = any nucleotide
  misc_feature (1072)..(1072): n = any nucleotide
  misc_feature (1074)..(1074): n = any nucleotide
  misc_feature (1076)..(1076): n = any nucleotide
  misc_feature (1078)..(1078): n = any nucleotide
  misc_feature (1080)..(1080): n = any nucleotide
  misc_feature (1082)..(1082): n = any nucleotide
  misc_feature (1084)..(1084): n = any nucleotide
  misc_feature (1086)..(1086): n = any nucleotide
  misc_feature (1088)..(1088): n = any nucleotide
  misc_feature (1090)..(1090): n = any nucleotide
  misc_feature (1092)..(1092): n = any nucleotide
  misc_feature (1094)..(1094): n = any nucleotide
  misc_feature (1096)..(1096): n = any nucleotide
  misc_feature (1387)..(1387): n = any nucleotide
  misc_feature (1389)..(1389): n = any nucleotide
  misc_feature (1395)..(1395): n = any nucleotide
  misc_feature (1401)..(1401): n = any nucleotide
  misc_feature (1405)..(1406): n = any nucleotide
  misc_feature (1409)..(1409): n = any nucleotide
  misc_feature (1412)..(1413): n = any nucleotide
  misc_feature (1415)..(1415): n = any nucleotide
  misc_feature (1418)..(1418): n = any nucleotide
  misc_feature (1423)..(1423): n = any nucleotide
  misc_feature (1431)..(1431): n = any nucleotide
  misc_feature (1434)..(1435): n = any nucleotide
  misc_feature (1439)..(1439): n = any nucleotide
  misc_feature (1441)..(1441): n = any nucleotide
  misc_feature (1444)..(1444): n = any nucleotide
  misc_feature (1449)..(1449): n = any nucleotide
  misc_feature (1457)..(1457): n = any nucleotide
  misc_feature (1461)..(1461): n = any nucleotide
  misc_feature (1463)..(1464): n = any nucleotide
atggcttgcgtgtgcggtgctgctnctctctctctcccccccnncaggggggcgcgccgcgcagcgaacacacacacccccacagagatggttgttttgtgtggtgtggggcggccccccccccccccaccaggcgaggggcgcgcacactatatggggtggtggcgcggcaggggggccgcgcccccccccccccccgccgcgcggggtggtgagaggaggagaacaccccctcttttttcttcctctcccgcgcccgtcgttgtnggngtccctcccccgggaggtgcgccccgcggggcgcgcccacaaagagaggaccgcctttgntgtggtttttctccccctcgcgggagtcggcctctctccctcctccccanccgctctttgttgtgtgtggagagngtgtgngcgcgcgcggcgcggagtcctntcnagananagttgtgtntntnggggtgngggcgcgcncgcgcncncncnccccccccccgcccgcgcgcgcgcgcgcgcgagagaggngngagncacncncncnccgcgagagaggngngngngngnggngggggggtgtgtttttttntntnananancncncncncncccactntntntngntcncncncncnccctccccgcgcgcgcgcgcgagcgcgcgctctctctctctttctatgtntcccgcgcgagnancncnctcncncncncncnctctctctgcgngtgtgtcncncnctctgtgtgngngngngngngngngngagngagagagagacacncccccccccccccccncngncntncntntntntngcgntcgngagagaggggggtgtcattnatanagagagagngagngngngngngngggggncncncncntntntntntntngngngncgcncncncncncncncncncncncngngngngngggngngngggngntntntntntntntntntntgtntgtgtgtgtgcgcncncncncncncccccgcngngngngngntgtngngngntctctcncncncntntntttntntatatatatcttctctctgcgcncngngngngngntntntntntntntntngagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagagggagagagagagagagagagagagagagagagangnccgggncccggngctnnctnagnnanggntagtnccccgctncgnnacgngnggnggccnccccaganggcntnn

SEQ ID NO: 5365 - DNA, 702 bp, Zea mays
  misc_feature (468)..(468): n = any nucleotide
  misc_feature (627)..(627): n = any nucleotide
atggcgtcgagcagcactgaccttgccgacgacggcttcgcggcgccgcgacttttctcgcagggtgtatcctacacatacgacgacgttatcttcctcccgggctacatcggcttccccgccgacgccgtcgacctctccacccgcctctcccgccgcatcccgctatccatcccctgcgtcgcgtccccgatggacactgtctccgaggccgctatggccgcggccatggcatcactcggcgccgccgctgtcgtgcactgcaacaccgatccccacgctcaggccgccatcgtccgcgctgccaagtcccgccgccttcccttcgtttcctccgtgccctttttctccccgtcctccgccccgacgctcaacgatttcgctggcaccgagtacgccctcgtcaccgagcgcggagattcgctctccaggctcgtcggcgtcgctgtcgcggccgatgctgcctcncgcgaggttcccgtctctgtctcggagtacatgcgaccgacgccgcgctcagcctccgccgccttcgactttgaggaagcagcaaccttccttgccgatgagggtctggattacgcccctctcgtatcagatgatggtgaggttgttgatctaatcaancgcaaggacgtggagcgcatccggagctatcccaagctggggcaagccgtctcctgggagccacggggaagtttg

SEQ ID NO: 5366 - DNA, 609 bp, Zea mays
atgaacatcggcaacccacccaagccatacttcctggacgtggactccggcagcgacctcacctggctgcagtgcgacgcgccctgcaggagctgcaacgaggtgcccgcacccgctgtaccggccaacaaagagcaagctggtgccatgcgtgcaccggctgtgcgcttccctgcacaacgggctgaccgggaagcacagatgcgactcgccgcacgagcaatgcgactacgtgatcaagtacgcagaccaggggtcgttcaccggtgtgctcatcaacgacagcttcgcgctccgcctcccaacggttctgtcgcccgtcccagcggccgccttcgggtggggctacttcaccgtacggtctcatcgctgcaccgtcgtttcggcttccgtcggtgtgttttggtccttgtttcgcggcgttctgccggccggttgcttctacaacgggccccccgcccccacaaccttcgcccgtcatttcacttactacggatacggggctcctcctcgtccctcgtgagccgacctgtgccatccgtggctctgttcctcgccccccacttactgccaaatccgctcctgctggatgatatcttatatggctgt

SEQ ID NO: 5367 - DNA, 462 bp, Zea mays
  misc_feature (414)..(458): n = any nucleotide
atgcccaacgggtcgctaggcgagatgctgcacggcggcaaggggggccacctcgggtgggaggcccgggcgcgcgttgcggcggaggcggcgcgcgggctctgctacctgcaccacgactgcgcgccccggatcatccaccgcgacgtcaagtccaacaacatcctcctcgactccgccttcgaggcgcacgtcgcggactttggcctcgccaagttcctcggcggcggcggcgccacgtccgagtgcatgtctgccatcgccggctcctacggctacatcgccccagagtacgcgtacacccttcgcgtggacgagaagagtgacgtgtacagcttcggcgtggtgctgctggagctcatcacggggcggcgccccgtgggcagcttcggcgacggcgtgcggacgcgtggnnnnnnnnnnnnnnnnnnnnnnnnnnnnnnnnnnnnnnnnnnnnngtct

SEQ ID NO: 5368 - DNA, 360 bp, Zea mays
atgactgttaggctagtagtaagctacaatggtctcagcattggcacagttcgagatgcatttgagaagtctcttggcttccggttgcaaaagatgaatcctaatactgattatggttgcttgaagacttttggttcttgttttagtgaagacattcgtatacctgctggtacaaagattgacttccggcaaacatctgatggccagctaataactgaaattgatggcaaacaaattggcactgtccagagcaaagatctttgcagagccttcttcgatatgtatattggtgaccccccagtttcagtggagactaaacaagacattgcgcaaaatgtggctggactcataagaagatgc

SEQ ID NO: 5369 - DNA, 666 bp, Zea mays
atgggcacgccggagacgtcgcgggagccgtgcccggaccggatcctggacgacgtcggcggcgcgttcgggatgggcgccgttggcggctccgcttatcacttcatcaagggcatctacaactcccccaacgggatgcgcctgtccggaggcgcgcagaccgtgcgcatgaacgcgccgcgcgtggggggcagcttcgccgtctggggcggcctcttctccaccttcgactgcgccatggtgtacgcgcgccagaaggaggacccttggaactccatcgttgcgggcgcagccacgggcgggttcctctctatgcgccagggcatgggggccgcgggccggtccgcgctcatgggcggcatcctgctggccctcatcgagggcgccggactcatgctcaaccgcgtcctcgccaacccgccgctgcccgccgacgatcccaaccttacagcggccatgggcggcaaccctttcccgggcctaccgcaggcgccgccggtcgtggcacctccggaagcgacgacctccagcggcgtgggtggcttgttcgggggactgtttggcaggaaggaggaggagaagaaacccagcgcaggcgggggcaagtcggagatcttagagagcttcgatacgcccagcagtccgataccatcgttcgagtacaag

SEQ ID NO: 5370 - DNA, 423 bp, Zea mays
atgtacatggtgccgatggtggaggacagcaccaggcgccgcacgccggcgtccgccgccgcctccacgacgttccgcgtcccggcgataatcggctcgatgatctcctcggggttgtcgtgcatcggcgaggcggtgtggatgacgccgtcgcagccgcggaaggcggcgcggaggctggcgcggtcgagcaggtccacctgcagcatggtgaggcgctccgccgcgccgtcgagcgcccacaggtgcgcgttcttggggtcagcagcttcgcggcgggaggtgccccggacggcgtacccgcgggcgaggaggatcttgacgatccacgagccgatgaagccgccggcgccggtgacgcacacgacggcggccatcgcgcgctgtcgcccagtcccttcttcttcctcctcctctcgagcg

SEQ ID NO: 5371 - DNA, 585 bp, Zea mays
atggccctgccccgccgacctcgggtacgaggccaactgccgggaggtggtggagcgggtggcgtcggcgtacggcgggcgcatcgacgtggtggtgaacaacgcggcggagcagtacgagcgggagagcatccgggacgtgacggaggcggacctggagcgcgtgtccccccccaacatcttctcctacttcttggtgtccaagcacgcggtgccgcgcatggagcccggcgcttgcatcatcaacccttcctccgtcaacgcgtacaagggcaacaagacgctgttggactaccacggccaccaaagggcgccatcgtggccttcacgcgcgcgctctcgctgcagctggccgacaggggcatccgcgtcaacggcgtcgcgccgggccccgtctggacgccgctcatcccggcgtccttcggcaaggagaaggtggagcagttcgggtcccaggtgcccatgaagcgcgccgcgcagccggccgagatcgcgcccagcttcgtcttcctcgccagcaaccaggattcgtcctacatgtccggccagatcctccacgtcaacggaggcgtcatcgtcaatagc

SEQ ID NO: 5372 - DNA, 462 bp, Zea mays
atgtgcgccgtggtgttcggcgacacgtcccggcacggcctccgccgccccgccatcgggcccttcaccatgaagctcaccaccccgggctaccccgtcgtggacgtcggcacctacgccaagatcaggagcggcgagatccgggtgctccccgccgccgtcaagagcgtccgcgggaacgtcgtcgagttcggggacggcagccgccaccctttcgacgccatcgtcttcgccaccggctaccggagcactgtcaggcggtggctcaagagcgaggacgggctggtcggtgacgacgggatggcggcgcggagctacccggagcactggaagggggaccacgggctgtactgcgcggggatggtgcggaggggcatctacggcagctgcgaggacgcggagctcatcgccgccgacatcagcaagctgctgcaccccaagcaggagcagggcaacggcgtc

SEQ ID NO: 5373 - DNA, 372 bp, Zea mays
atgcacgagcaagcatcagcgatcgtcaggtatgagctaagtcgaatatcagctggtgtgttcattgcacttggtaaaggaaaagtgcagtgtcgtggtgacgtacgaagcctcctctttcatggatggttcagcacaatgttgttggattttggctggcttcagcgctgccccaaaggtctcgacctaagatcgttggaggagaatttagggcgaggccttttaaccctccctctcaggcagcagcaatgtttgttcgaggaatggttccagttctatgcgaccaaaggacccgagtgtccgaaccttattagagctttccaggtatggtggagaaggtctttcattagatcattggtagaacctcaaaac

SEQ ID NO: 5374 - DNA, 309 bp, Zea mays
atgcgccgtctgcttgccctgccggattggattgcccgcagacgaacccagcagtttatttccttcgcttctctatctggacgagcatccgctgggtgcttgatgcagttgcagtgcaactactctagggcagtgatcgctccatctcagtttgcagagctgtccttgattgtgaaaaggacactggagtcaaaaacttgttggcctgcagtaaccttcaggccactcacgtatccggcacgaggcgccttcacaacatgctccatcttcattgcttccataaccatgacaggctgccctgcgtccacc

SEQ ID NO: 5375 - DNA, 906 bp, Zea mays
atggcggcggtggcggagggatcggcgtctgctgcggcgaaggaggtggagtaccaggcgggcgtgcagaagcttgtggacctgctctccaatcttaacccggccgccaaggagttcgttccttcctcggctccggccgcggctgcgtcgccgcccaagaaagcgttgtcggcggatgcgccggtcttcgattaccgctccaccgcaggcggcaacggggccaccgacgatcccttttacgttgggtttgggaaccagcagcgcaagagagggaatggatacatcaaccaaggaaggaggaggacaaatgataggttgaggcgtgcagacagagaggacagcgttaggcgaactgtttatgtctctgaacttgatcatactgtgacagaggagagacttgctgatatctttgctacctgtgggcatgttgttgattgcagaatttgtggtgatccccactcagttcttaggtttgcatttattgagttctctgatgaagagggtgcaagaactgcacttaacctcggaggcacaatttttggtttctaccctgttagagttttgccttcaaagacagctatcttacccgttaatccaaagtttcttcccaggacggacgatgagaaggaaatggtcatgcgaactgtctattgtacaaacatagataagatggttactcaattagatgtaaagaaattctttgaagaactttgcggtgaggtctctcggttgagacttctaggagacaatgtacattccacaaggattgcttttgttgagtttgttcatgctgagggtgccatcatggctctgaattgcagcgggatgattttgggaactctgcctgtcagggtgagtccttctaagactccggtgaagccacgtgtaaatcgaatgggatctaac

SEQ ID NO: 5376 - DNA, 540 bp, Zea mays
atggatgcatacatacacaggaaggatctggctgagctctgttgctcagcaggcgacgaactggtagtcgacgttgaggtggcccatctggtagccctgcccgttggtgtcgatcttcttgaacaccgtctcgtagtccaggtccaggccgccgttgctgcactggtccacgatcctcgccatgatgacgcgcccgtcgcacggttcttcacccttatgcacttgccgcaggcggcctggcccttctgcccggcgggcccgcagaaggccgtccagccgtgcttctgccgccacgacagcggcttgtcggcgtcccacgtggcgcagtacgcgctcacgcggttcaggtcccacccgttctgcgccgggttgtacaggtggtacgtcgcccgcacgttcgacgcctgctgcgccgccgccatggccgccaccgcgcagagcacgcccgccaccgccagcgccgcccgtcctccggagaccatcatcgccgccgcagcagccatcgtcgttgcctcttttctttgccaaactaacgatata

SEQ ID NO: 5377 - DNA, 495 bp, Zea mays
atggagctttcattggtagggctccaaaatgctgggaaaacatcacttgtgaactccattgctactggaggttttagtgaggatatgatccctactgtaggattcaatatgagaaaggttaccaaagggaatgtgacgataaaattgtgggatattggaggccaacctagattccggagcatgtgggagagatactgccgtgcggtttctgcaattgtgtatgttgttgacgcggcagatcgtgaaaacatggccattgcaaaaggggagctccatgatctcttgagcaagccatctttgaccggaataccattactagtaattggcaacaaaattgacaagcctgaagctttccctaaacaaaccttcacagaaataatgggcctaaagacgatcactgaccgagaagtggcatgcttcatgacatcatgcaagaactcgaccaacattgattctgtcattgactggctggtgaagaactcgaaaaagaagaat

SEQ ID NO: 5378 - DNA, 258 bp, Zea mays
atgggcagctcgatggcggcagccgctgctgcgcccttggagccgcctgatgctgagacatcggccacgctgtccttgctcttgccccagatgagcgcgtacagacctaacacgatgatcgcagcgccaatcacgcttccgagagtgatctcttctttgagtatgatggagcccatgacggcggtgatgatcatgcagagagggttgaaggccgtgacgaacaccgggcctcgttgcctggacacgatgccttgcacg

SEQ ID NO: 5379 - DNA, 258 bp, Zea mays
atgcatttaggttctgagatttatcaggaaacattggtaaaggcacttgctaaacattttggtgctagacttcttgtcttggattcacttttgctaccttgggtaagctcatactgtatatttatttacctgctcatgaacattcagaagctaagaaactttgaattattgcacgttctattacaattttcctatactgaacatgagacttctcataggcaacccagttatgagcttgcttttgtattgactatcctg

SEQ ID NO: 5380 - DNA, 252 bp, Zea mays
atgaactgcggtcgccctgtcgtcgccggccgcttcgccccgcacctcgagaagtgcatgggcaagggacggagagcccgaacgaaaattacaaggagcagtacggctgggcgcatgagaagcagcaatggcagcgttgccactccctactctccatactccaccacggcgaaccctaatagggcaagcatccctaatggtgtgactgacggcggcggcggcgcaaggggagattacagcaaccatgcgccc

SEQ ID NO: 5381 - DNA, 399 bp, Zea mays
atgaggaggaagaagaagaagcaaacggttaagaacactgctagctgctcgatcgaggccgaccgaccctcctcgtgcatgcggagttgcatggaggcggatcggtcgacgcacccgccaccgcgcaaacctgacacctttgctaagaaatcccatcggcgttcgccgaacaggcgcacgaaccgtaccagctgctcgtcctcctcgtccgtccacgggcccttcctcatggccgcgccgcccgtgctgatgatgatctgctcgccaccgtactctccatcgccatcgctgtccttcttgttgttcctgcggctaatacatagcaaggacgacatggtcgatcgatcgatcgatcggtcgctagaccgtaccaggcagctagaaagcaaggaccaagct

SEQ ID NO: 5382 - DNA, 1284 bp, Zea mays
atgtcccccgccaccaccccgttgcccgcccccgtggcagccccagcgtccaagggcgggaaacgcagcctcatgtcgtcactcatggacgccaccgcgctgctccgctcctcctccttcaaggaggactcgtacgtggcggcggcgctcccggcgtccgagctccgcgcgctcgccgacctcaaggcgctggtggccacccacccggaccccatctccatctggggcgtcccgctgaatccccactcccctcctcccggcgcggcgaacgacgacgccgacgagcgcgccgacgtggtgctcctcaagttcctccgcgcgcgggacttccgcgcgcgcgacgcgcacgcgatgctgctccgctgcgccgcgtggcgcgccgagttcggcgcggacgcggtggtggacgaggagctgggcttcaaggagctggagggcgtggtggcgtacatgcacgggtgggaccgggacgggcaccccgtgtgctacaacgcgtacggcgtgttcaaggacagggccatgtacgagcgcgccttcggcgacggcgaccgcctggcgcgcttcctccggtggcgcgtccaggtgatggagcgcggcgtgcgcgcgctcacgctcaggccccgcggcgtcaacgccatcatacaggtgaccgacctgagggacatgccgaagcgggagctcagagccgccagcaaccagatcctctccctcttccaggacaactacccggagatggtggcgcgcaaggtgttcatcaacgtgccgtggtacttctccgtgctcttctccatggtctcgcccttcctcacggagcgcaccaagagcaagttcgtcatcgctcgcgagggcaacgtcgccgagacgctgtacaagttcatccggccggagctggtgccggtgcagtacggcgggctgagccgcgccggcgagctcgagaacggaccgccgaagccggcgtccgagttcaccatcaagggtggcgagaaggtgttcctggagatcgacggtatcgaggccggcgcaacgataacgtgggacctcgtcgtcgggggctgggacctggagtacggcgccgagtacgtgccggcggccgacggcagctacaccctctgcgtggagaaggcgaggacggtcccggccacaaccgccgacgccgacgccgggccgctgcacaacgccttcacggctcgggaggccggcaggatggtgctgtccatagacaactccggttcccggaagcggaaggtcgccgcctaccgctacttcgtgcgcaagccgtcggcg

SEQ ID NO: 5383 - DNA, 330 bp, Zea mays
atggtatcctcccagctcacgggctcctccgacgtagcccaacgttcagaggaatggtttgctcttcgcaaggacaagctcaccacaagcaccttcagtactgctttgggtttctgggctggcaacagaagaccagagctgtggaacgagaaagtcttcggagcgacagagatcaagctagcagatgccgctagatctgccatggactgggggacgcatcacgaaagcgtagccatagagcagtacacgagcatcacaggaagacccggtgggcaccctcggcttcgcggtgcacaccgaggccagcttcggatggctcggagcctcgcc

SEQ ID NO: 5384 - DNA, 456 bp, Zea mays
atggacacgctggtcggcagcgtctcgaggctcgaaaccgacctcgagaaggtgacgctcgtctcccggctcaggcagacgtgtcccggtgacgatcaggtctcaagcgagaagttcttcgaggcgaacgacgcgttcctcggacgtgctcacgcggagatcgaggcagtgaaggcggccggggagcgcgcgctgcagcgcgtcaaggagaccacggagtacttccacggggacgccgtcaaggaggagcctcacccgctgaggatcttcatggtggtgcgcgacttcctcgcgacgctggaccgcgtgtgccgggccgtcggcaggacgccggagagggtgatgatggggtccggcaagtcgttccgcgtctcggcgggcacaacctccctgccgcagcgccggaacgaccagcggagggagctgagctcctctgacgaggacagctcctcgtca

SEQ ID NO: 5385 - DNA, 600 bp, Zea mays
atggacgagaccgcccgcctctgggacgcctgcctcgccgtcaaactcggcctcgcctccgtcgagcggtattgcgcagcggcctcgtgcgccgccgcggcgctggatgactggctccaggatccctcccctctgtccagtagccaggtgatgcgggcgatctccgtgtcgaggagggaggccatggccgcggaggaggagaaccgcgcgctggcggacgcgaggatcgcgccgctctcgctgcagctggacgagcggcttctgctgcgcgcgacggacgccaggcttacgggcttcaacggcttccgggggctgctgcacgcgctccacagcgcggagctcgctcctcctgctcatccgcgccagcggggccgtctcgagcgaccgccgtggcggcggcccgtgccgcgcggacgacgccgcgggaacggtttcgccggtctctatcgcggtgttggtagcaagcggctgggggttgggagccaccatgacgcgcgagtcggtccgcggatgagagcccgcgggccctcgttgtgtacgggttatcgcgctgaacaatgccgcgatattttcgcgatcgcgaagagattgtacgtcgat

SEQ ID NO: 5386 - DNA, 423 bp, Zea mays
atgcaccatggtagtacgtactacagaccctaccgctacgctacgctgtccttggaacgacagcggcgtaccgcgtacgcagcgcgcgaagaagctagctataccgacgaggcgacgacggcaagatcgggtcgagagggtagtagtagccgccggggaggtggagctggtcggcgccggcgaggtcggggcccgcgcagaagtccagcaggaagagggacgcttcgcctgcgccgttctccgccgccgaccagttgttggaggccgacgacgccgcggaggcggccgaggtggagccgtcggcggcggcggcggcggcggcgaacgggtccccgaggccgagcgccggcgccaggaagtcgtcgcaggtgtacgcctcggtcttcacggtcggtatggcgagcgacgggaacagcgaggacg

SEQ ID NO: 5387 - DNA, 828 bp, Zea mays
atggcctactactcgggcggcggcaagctgtcggcggtggacgccatcctggcggaggcggcggacctggtggcgctcgagcaggtcgccaagctcaacacggcccacctcgatgacgactccgcgcttccgtccagcctcgaggcccgcttccgcaagctcaagtccctcccctcgcccgccgcagtgccgcccgtcagcaccctcgcccgcagcgccaccgcgccgcgcccggcccccgctctgcccggccccgatcctcccgctcctgctccgcctgtgcatcacccggtccacgaagacccgccgccgggagacgcggagacgaagggcggcgggtcctcgccgcggcaggctcgcgccccggcacccgcacccacggtccacgccgacgacgccaaggacctagatcagctgttcgggtcggcgccgcggggccggccgacactgcgggagcggaacagggggagcgactcctcctccgtctccccctcgccgctgccgccgccgcgccaggcgtgctgcttcggcttctcccccaagaagcccctgcggagggcgccgtcggccaagggcaagaagaaggaggtctgccacgggtcccgcgacgtcctcggcgtcgacgccgacgagtggggcgacgagaacaggaggatcgccaccgagctcagggagcagcagcgccggctcaggaaggcgctggaggaccaggtgcaggtcagcagggagaccgccaagatggcgcgctgggtcaagcaggcgtccgcgcgcatgacgcacgccgaggccatcgacgacctgctcagtgactgcgaggacgacctcaaa

SEQ ID NO: 5388 - DNA, 225 bp, Zea mays
atgagagaaatagaggaatgtcggattagtggcaccatccttgtaataggcgaataccacggacgcttcgtccttcatgctctcaccaacaaaaaattgaaggtccttcagcttgctaaggagaaacttggttgcaccctcgacaccctttttgaactcatccgctttctctggctccaacacagcagtgagattcttgatgtatttttttatgtaagagacaaa

SEQ ID NO: 5389 - DNA, 480 bp, Zea mays
atgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatattccgcatgtgaaccgtactgagtaccagctgattgatatatcagaggatggatttgtgagccttcttacttcagatggcaacactaaggatgatcttagactcccaactgatgagactcttgtggcccagatcaaggaagggtttgaaagcggcaaggatcttgttgtgactgtccagtctgctatgggggaggagcagatctgcgcgctgaaggatgttggccccaag

SEQ ID NO: 5390 - DNA, 627 bp, Zea mays
  misc_feature (618)..(618): n = any nucleotide
atggctaactcaaataaagccaggaaggcacagaggatgcagtatgttccgacaatcactaatcatactcaagtttggtgggttcctaatgttgttgttgtacatgaaaaggaagggatagaggttgtccatctagcttctggacgtacaatatgcaagcttcatttaaatgaaggaggccttcatgcagatattaatggagatggagttctggatcatgtccaggttgttggtggaaatggtattaaagagcagactgtcgtgagtggatcaatggaagtgctgaaaccctgttgggcagtcgctacatccggtgtgccagtgcgggagcaactttttaacgtctctatctgccattacaaccattttaatctgttccatcatggtgacttctcgagaagttttgggaggacatttgatacagctggtttagaggtcgcgactcctatcctggtccagacagacgatgggcataaacacaggagaggaagccatggtgatatcatctttttgacaagccggggagaggtgacatcgtactctcctgggctgctcggccatgatgccgtgtggagatgggcagtatcatcaggggcgacatggtccacccttcatctncatcgggaa

SEQ ID NO: 5391 - DNA, 1032 bp, Zea mays
atgctaagtcgtctacatcaccgcaaccttgtcaagctgattggtatatgcattgagcggagcacaaggtgcttggtttttgagctcgttccaaacggaagtgttgaatctcatctacatggctcagataaaatatatggcccgactgattttgacactagaatgaaaatagccctcggcgcagcaaggggactagcctatctgcatgaggacgccaaccctcatgtcattcaccgggatttcaaggctagcaatgttctactggaaaacgatttcacccccaaggttgctgattttgggctggcaaaggaagcatcagatgggatggatcatatttctactcaggtcatggggactttcgggtacgttgccccagagtatgcgatgacagggcatctgcttgtcaagagcgacgtctacagctacggagtggtgctcctggagctgctgtcaggccgaaaacccgtggacatgacccagccgccggggtccgagaacctggtcacctgggcgcgcccgctcctcaccacgcgggaaggactgcagcggctggtggacccgtcgctcccggccggttacgacttcgagaagctggccaaggcggcggccatcgcgtccatgtgcgtgcacgtcgaggcgtcgcaccggccgttcatgggcgaggtcgtgcaggcgctgaagctgatccacagcggcggaggcggcgacgagacctgcagcggctccttcgtgggcggcgcaacagaggagtccccgtggaacgacgtcagcaggagctcgtggaacgacgacccgccggccactccgggcccggcgctccccctgggatacggctcggaccctgccggcgccgacgagcgcaggccacggtcggcgtcgagcgcggtgctggacaagatcgagtccctggcgatgtacgactggtccggcccgctgcgcaccaaggggaggggcagcttctacaggctgagggggagcatgagcgagcacggtcgcccctcggacgacggtagcgtcgaaggttacttgatg

SEQ ID NO: 5392 - DNA, 987 bp, Zea mays
  misc_feature (876)..(876): n = any nucleotide
atggcagaccagttagggtcttacacaattagatcccatggaatgatattggcaagattacacatgtatgactggataatacttctcctccttgctgtcatagacgggctgttgaatataattgaaccatttcaccgttttgttggaaaagacatgatgaccgacttgagatatcctatgaagggcaatacagtgccattttgggctgttccactgattggaattatactgccttgggccatctttgttggaatttacttcaagaagaacaatttttatgatctgcaccatggcatactggggattctatactcagtgctcataactgcagtgattactgatgcaattaaggatggtgttggacggcctcgtccagattttttctggcgctgtttccctgatggaaatgatgtttatgataacatcactactggtgttatatgcaatggagtgaagagcgtaatcaaggaaggccacaagagctttcccagtggacacacttcatggtcttttgctggtctaggcttccttgcatggtacttagctgggaaactcacggcttttgatcgcaaaggacatattcggaagctatgcattgtgtttctgcctcttcttactgctgcgcttgtggctgtttctcgagtggatgactactggcatcattggcaagatgtatttgcagggggtcttataggtcttacagttgcttcattttgctatctacagttttttccatatccttttgatggcgagggaccgaacaactccccggttttaccaagctatatagtgagttggcaggctttgttcaacaagacgcagaatattggacatcaactcggcagctttgtggcctcacgcagacactgtccagtnagccgaggaagggagcagcagaaatacaaactcctacagcgtgagaccagccgagatcgaaacagtcaatattcctggtcacggtgggatcaccctaagagatactctaaa

SEQ ID NO: 5393 - DNA, 939 bp, Zea mays
atgtacacgagccttgctccgcacggtcccctgaagctgtaccacttcgtcatcatggtggccgtggtgctggcctttctctcccagctaccgtctttccactcgctgcggcacatcaacttcgtctcgctgctcctgagcctgggctacacagtcctcgtggcagccgcctgcgttcgtgctggtttgtccaagaatagtcctgcgaaggactactcgctaagctcgtccaagtccgagcagtccttcgacgctttcctgtccatttccatccttgcctccgtcttcggcaacggcatactgcctgaaatccaggcgacgttggcgccaccggcagcggggaagatgatgaaggcgctggtgctgtgctactccgtcatcgtcttcaccttcttcctctcgtcgatcacgggctactgggccttcggcagcaacgtgcagtccaacgtcctcaagagcctgatgccggactcaggccccgccctcgccccgacgtggctgctgggcgtcgcggtcctcttcgtcctcctccagctgctcgccatcggcctcgtctactcccaggtggcgtacgagatcatggagaagggatccgccgacgccgcccggggccgcttctcgcgccggaacctcgtcccgcgcctgctgctgcgcacgctctacctggccttctgcgcgctcatggccgccatgctccccttcttcggcgacatcgtgggcgtggtcggcgccgtcggcttcgtcccgctcgacttcgtgctccccgtcctcatgtacaacatggcgctcgcgccgccgcgccgctccccggtcttcatcgccaacgcggccgtcatggtcgtgttcgccggcgtaggggccatcggcgccttcgccaccatccgcaagctcgtgctggacgccgacaagtttaagctcttcaaaaacaaagttgtcgac

SEQ ID NO: 5394 - DNA, 234 bp, Zea mays
atggtgattgggtggagcatgcattgcctcaacagtacatccatagtttcaaggatgggcagttcaccacttcaccagtttcacactcaggagcgtgaatacaattgttactgctgttgttttttgttgcccttgctcagtccgcggtgtgtatgtcctgcatgcacgtggttcctttctgttggtgtttttgtgtgccaacaaaccaccaaacttggtttgtatgtctttagc

SEQ ID NO: 5395 - DNA, 261 bp, Zea mays
atgagtacagctctgggacttttacactgtccaactggtatgtttggtgtaaatcggtttgatgcaatccttccacctggccagggagctattatggctgttggagcctcgaaacctacagttgtggctgataaagatgtttctttagcgtcaagagcaaaatgctggtcaatgtcactgctgatcacaggattgtatatggggctgatttggcagcattcctacaaacttttgcaaaggttattgaggatcctgagagct

SEQ ID NO: 5396 - DNA, 585 bp, Zea mays
atgtcaccgttcgacacgtactgcagcgtgattgcacgcgccgccgccgcccacgtgcacgcgcgcgccgggcccgtcgatcgtcttgtagctgttcaccagcagctcttcgttcagccggatggccatgtccgacgcgaacacgatccacagcgggccctcctggatggcggcgtgccggagcgtgccaggggacgggttcacggggtcgcggtccgacgggtccgtcaccacgtacaccggcccgcccttgccgcccagcgcgttgcgcccgaacccgatgccgcagtccgccagccgctgccggtcctgccgccagtccgtccccgcgcaccgccagcagtcgtcgattgggttgcccgtcaagcacccgccgccgccgccgccgccaccgccgccggactcctgcatccgccgccgcgacgttgccaccttgctgtgcaagtcggcgacgacggcagcggggtcggggagcgaggagttgaggagaggaaaggccgaggctttggcggcggctgccagcagcaggagggagagggcaatgccggcggatttgggagctcgggccatggttccttggcggat

SEQ ID NO: 5397 - DNA, 210 bp, Zea mays
atgctggaggggagggcgcgggtggaggacacggacatgccggcgcggatgcaggacgcggcgacctccgcggcctcgcgcgcgctcgacctcttcgacgtcgccgactgccgcgccatcgccggccacatcaagacggcacgttctctctcctctcctctcctctctctgctctgccgccgtcctcgtgtcacatttttaattgatgga

SEQ ID NO: 5398 - DNA, 333 bp, Zea mays
atggagaacctaaaggagcagcggggccacgacgcggcgggcgccaacgcctggatgacggtgccggcgttcggggactgggacacgaagaacggcgcgctgccggactactccatggacttctccaagatccgcgagatgcgcaagcagaacaagaaggagctctcccgcgccagcctcggcggcgacgacgacctcctcgcccacgcccagaagccgcagcccagtatcgccccgcccaagctcggccgcccccgccccggccccgccgacgaccactccccaacgggagggaagaagttcctgagctacttccggtgttgtatcaaggcc

SEQ ID NO: 5399 - DNA, 252 bp, Zea mays
atgcagcttggacagcctgacgcttttcatgccgtgcttcccatcccaggcagcagcaatcttcaatggtatcatgacgagccgactgggatcagcttgacggcggcagcgatgggcatcccggccagaccgaggagcacgctggctagccactggtgtatggtcaggggcgtcgtgttggcgaactctcctagaaactgcaccatgatgaactggaagatcaccgtgctgctgaggacagccatgaacacg

SEQ ID NO: 5400 - DNA, 369 bp, Zea mays
atggcccgtatcaaggtgcacgagctccgggggaagagcaagacggacctgcaggcgcagctcaaggagctgaagtctgagctctccctcctccgcgtagccaaggtcaccggcggcgcacccaacaagctctccaagatcaaggtggtgcgcacctcgatcgcgcgcgtgctcacagtgatctcgcagaagcagaagtcggcgttgcgggaggcgtacaagaagaagaacctgctccccctcgacctccgccctaagaagacccgtgccatccgccgccgtctgaccaagcaccagctctctctgaagaccgagagggaaaagaagcgtgagaagtacttccccatgaggaagtatgctatcaaggcc

SEQ ID NO: 5401 - DNA, 591 bp, Zea mays
atggagctctgcgtctctacacccccatcctccgtccgcgccaccgccgcgcccatatccttcgccccgccccgacgtggcgcgtctgcctccaccgccgttccgccccaccgccgcatcccaactcgaggctggcgctgcgccagcgcggccgtgcctggcccggtgccctccgaagagccggcatccgcctcctacgccgtcgtcgtctcggacaagcccgatacgcctgccgacgacaaggccgaggaggttagcgccgcgcctagtggctccgcggaggcgcctatggcagagctagtgccgtcagaggcgtccccgtccccagatgatggcggcctggatgagattctaagcaagttgaacattgaagtgtctccaactttaatcctcactggatttggtgcttttattgctttatggatcctatcttctgttgttgctgcagttgattcagtccccctgctcccaaaattgctggaattaataggaactgcttacacaatttggttcatcgcacggtatctccttttcaaggaaagcagagatgacctgtttgcaaagttcgaagatctcaaacagaggattatt

SEQ ID NO: 5402 - DNA, 456 bp, Zea mays
atgatttatctgctgaacaatttgcaccttgccggaggcggcgccaaacccaccgatgtcggcgtggtcatcgtcgtagtggcgggcgtcggcctcggcgtcgtcgaggggcagctggacctgcgcgagcatgaggtagttgggctcgttgtcagaggtgtgcgtgccaaggatcatcttctggacggagtggtccttccccggcggctcggtgcggtcggggagccactgcacggtaagggagggccattcgagcgcgtgggtgatgacgaggtcgtagaggaagggtgtgttcttcttccagatcttgtactcctcgttgatgaggcgctcctccacctcggcgcggaactcctcttcgtccgccgccccgccgcctgccttcggcatcgtcggtccgccgggagcgggctagggctagggttagggtttgagagcggagggggtttgagttgg

SEQ ID NO: 5403 - DNA, 276 bp, Zea mays
atgtctgacatccaatcaccactgctgaacaaaggcagttggccacctttaggttcaagtggcaatacagtaggatccacattagcatcaacagtacttgatgatccagctgttcgattcaggccgagttttcgattagaatttaacgaattgcctttccaacttaagatatctgctggaataagagcaccaggagcagccatcagatcaaccaaaaactccctttcattgtccatcttaattatgtttatagcatcgtcgtcatcaccaccagta

SEQ ID NO: 5404 - DNA, 786 bp, Zea mays
atggacccggcgctcaagaccgacgccaaccgcgtccggggttgcgtctcacaggtctgggtccacgccgagcccgacgagggcgacgccggccgccgcagcgtcaggttccacgccgactccgacgcgcagctcaccaagggcctcgccgcgctgctcgtgctagggctctctggcgcgcccgccgcggatgtggccagggtgcccgttgacttcatcgagctgctcgggatcaggcagagcctctctccctccaggaacagcggcctgctcaacatgctcagcctcatgaagcgcaaggcacttgagatcgccggtggtgactcaacgtcaagtcagcaatctgtccaagaggttaccagaccgcgtctagtgaacgggaaagagcctgaatttgcagctttcgaggtgcaagaaaaggaaaaggaaaggccacaggatgcagagaggcgcgacgaggatgaacaattgggtcaacttctaccacttgatgcagaagtgaatggtgctgcgggcggtgggaggaaggagaggataagggagagtttggagagggcactttctccggtagagttggagattgaagacatatcacacctccacaagggccatgctggcgtggctgggaccaatggggagacacatttcaatgtgagggtggtgtccaaggagtttgaggggaagagcttgctcaagaggcacagggctgtctatgatctcctgcaggaggagctcaagaccgggttgcacgccctgtcaatcgatgcaaagactccatctgaagtt

SEQ ID NO: 5405 - DNA, 297 bp, Zea mays
atggtggcggcgcgcgtcttccagctcacgcgtgaactcggacaccgcaccgacggagagaccatcgagtggttgctgcgccaggccgagccttccataatcgccgccaccggcaccggtgtcacgaccgaggaggcgccgtcgtctctcgtccccgtctcctccatcgcgtcctcagtgtcccttacgccggtcccgtactacaccgcgctcctcatgcaaccaccgcccaccgccaatgagtcccctgtcgcctctgcatccgtatctggcactgttgcggaggagaataacaac

SEQ ID NO: 5406 - DNA, 402 bp, Zea mays
atggctggcgctggggacgagtactactacggcgggccggggcaggggcaggggccgcgcggcgccccacacggcctgctgctggcggtggtggttggcctcgtggtggcgggcccgctgtttctgggcgacggcggcgaggcgctgacggaggccgtggcggagctgctgagcccggtcgggctgcttctcctccccgtgtgcctgctgttcctcatccgcctcctctcctccgaccgcggcgccgcggcgctcgccgacgtcttcgccttcggcgggtcccccgacgccgtccaccgcgtcggagggtcccccgtcggcgtcgcgctcatgctcctcctcatcctcgcgctgctctactaccgctcctcgctcttcggcggcggcggcgacgacgacgag

SEQ ID NO: 5407 - DNA, 417 bp, Zea mays
atgacgtgtgcgccgctgcagcgtgccagcgtcagcggcggcttgtggttccgcaggtactgcaggaacgtgttccagtcccggcgcttctgcgactcgtaccggctgagccccgccggaggctgctgcgttagcggctgcggctgcggctgcgcctgggcccttactgctggctgttccctctgctgtgctccttgttgctgctgtgcttcctgctctgcctgctgccggctcgacgaggaggctgctgcggcggccgaggacgacgacggcgacggcccggcctctgctggctcactggttcctcctccgccaccaccaccggcaggcgcgtccggaccaggctccatggccagcaactccccgatcgatccgttagcagctctccctgcctgctgccgtttaagtgtagccgtt

SEQ ID NO: 5408 - DNA, 396 bp, Zea mays
atggaaggtcgcgttcttcagggacgagctcgggtggacggaggcgcaggtgaagacggcagctgcgaagatgccgacgctgatgacggtctccgcggagcggatccggaggaactgggagttcctgaccacagaggtcgggatggacgcggagcgcgtggccagcttcccggcgctgctgaggtacgacctggaggggcggctggtgccgcggttccaggtgatgagggtgctgcaggcgcggcggctgtggcgcggcagggacttcaacaacatcgctgccatcacggaggaggatttcgtggccaagttcatcaggccatttctggtcaaagtcccaagcttggccaagatctacgaggccgctgtcatcgagaaggaagaacagtagcggga

SEQ ID NO: 5409 - DNA, 678 bp, Zea mays
  misc_feature (581)..(581): n = any nucleotide
  misc_feature (637)..(637): n = any nucleotide
atgaacctgtccacgttgcgcatagagcgtccgttgagcttcgccgcggccacggcgctccccttaagctccgtgacgcggcggcgcatgtcccgccctttctccccctccatggcctcccgtatgagcgccttcacctcgccccgccggacgtcattaccgatctccatcccgatgccccactcggtgcgcttgtaccggcagttggtctgctgctcagcgaagaagggccagcacaccatgggcacgccgccacagatgctctcaatcgtggagttccacccggagtgcgtcaagaacaaccccacggcctcgtgctccagcacctctgcctgcgggcaccacgtcgacagcatgctccggccctccgtcgcggccagaaactccggtggcagccccgcgccggcggagtcgccgccccttgacgaggtccgggcgcacgttccagagggaggtgtagcgggtgttggccaacccccacgcgaactcgaccagctgctcgttggacatcaccgtgacgctcccgaagttgatgtacacgaccgagcgcggggcgcggtcgtcgagccaccgggagcggngcctcctgttccttccataggtgggcacccgatggccggaacgggctgtccgccgnggacgttgttccgcaccgtcagcaggagcgggcccacggtg

SEQ ID NO: 5410 - DNA, 825 bp, Zea mays
atggaattcacggcccaggagggggaggagcccgtctcggaggagatgggcgcgagctccgcgccgccgccctgcctcggccccggccgcggcccggggaaccagaaccacgccgccgaggcgacgtaccacgagtgtctgcgcaaccacgcggcggcgctgggcggacacgtcgtcgatggctgcggcgagttcatgcccgaggacgccgacaggctcaagtgcgcagcctgcggctgccaccgcagcttccaccgcaagggcgacgcggggcgccgccaccagctcctgctgccgccgcccgccgcggcggtcccgcgcgtcccgctgctcctgcctccgccccacccctacgcggccggcgctgcccacccccactacgcgtcgccgccgctgttcccgtaccacggcacgcccagcggcaccacgaccgagtcgtccagcgaggagcgtggcccgccgtgccgggttcgccgccgcgccgcacgcgcacgcgcagggccacgtccggcggaagcggatccggaccaagttcacgccggagcagaaggagcagatgctggcgttcgcggaacgcctcggctggcggatgcagaagcaggacgacgcgctggtgcagcacttctgcgaccaggtcggcgtccggcggcaggtcttcaaggtctggatgcacaacaacaagcacatcggcagcggcggcaggaggcagccgccgccgcacctgccgcctcccgaggggcagcaacagccccagcagccccagtagccacggtgggagacaaggctcagcagtcagcagcaccaccaccaccaccaccatttgct

SEQ ID NO: 5411 - DNA, 177 bp, Zea mays
atgcttaattgcattgatcgatcaacatctgctgcagcaagcttatctgcaggatccaagtccttcagagtggccagtttcttaaggagggaactcctttccacacagcagattaattcctcatggcttggatctgaagcagctgcagtactccgtaaagcaatgtcaagcagagac

SEQ ID NO: 5412 - DNA, 624 bp, Zea mays
atggatcagagcttcgggaatctcggggccggagctgggagcagcagcgggggctccaactccaaggcggcggcagccgccgtgtcctcctcgtctttcctgcagctgccgctgtcgacggcgtcccccgcgtactacggcgcgccgctcgcgctcctgcaccacgccgccgcggccccgtcgtcgtcgcagcagcaccagcagcagcagcaccaccaccactacgccaggcacggcgccgagatgtcggcagcggaggccgaggccatcaaggccaagatcgtggcgcacccgcagtactcggcgctcctcgccgcctacctcgactgccagaaagtgggcgcgccgccggacgtgctggagaggctgacggccatggcggcaaagctggacgcgcgcccgccgggccgccacgagccgcgcgacccggagctggaccagttcatggaggcgtactgtaacatgctcgtcaagtaccgggaggagctcacccggccgatcgacgagggcatggagttcctcaagcgggtggaggcgcagctcgactgcatctccggcggcggcggatcctcctcagggcgcctctcgctcgccgatggtaaaatcagaaggtgttggctcttc

SEQ ID NO: 5413 - DNA, 600 bp, Zea mays
atggatcgcctgcccgagtcgacccggagcatgaggaagtacgcgtcggaggccggcgggctgcgcgcggcgcggcagggcccccacgggcggtcgctgacggcgcgcacggcgcacagcatgtccacgacggcgctgcgcaccaagtccaagtcggccgcgtcgctgctgcgcagggtgcccttcgcgccgctccgccccgtcctcgccaacctgcaggaggtgttcctcggcaccaagctcgccgtgctattccccgccgtgccgctcgccatcgccgcccagtgcgcgcacttcggccaggtgtgggtgttttcgctcagcctactcggcctcatccccctcgccgagcgtgtcagcttcctcaccgagcagatcgcgatatacaccggccccaccgtggggcggcctcctcaacgcgacgtgcgccatacccccggagctcatcatctcgctcttcgcgctcatggagggttcatattaaggtctgtaagtgttccctccttcgtctttgacctcctccacttgctgctttttgcttgtgcacgttccttcttttggccggggcgtcctactaccctcgtttcctatccagcgcta

SEQ ID NO: 5414 - DNA, 333 bp, Zea mays
atggcgccgccgccaccaccaccaccaccggcgaaaacggaacggcaaactggacatgtgtgtgcgcagctcatcctctcggtgaaccagactccaacagcagcttgctgtccaattgctcttcctcctgccattgccaccgagatgagaacggcggcggcggcggcggcggcgcaggctcgtggaactgcacgtgtgcctctggtgatgagggccttcagaaggaagagcatgctgagctacgtgacgggagctgtttcacttcctgcaactgcacgtcgggtactggaacttcagaggaagggagaaagcgtgtctcaagcaaaacagtca

SEQ ID NO: 5415 - DNA, 483 bp, Zea mays
atggcggacgcgaagcagcagcagcagcagcagcagcagccacagcaggcggcagcggcagccaccggcgtgtggaagacggtcaagcccttcgttaacggcggggcctctgggatgctcgcgacctgcgtcatccagcctatcgacatggtcaaggtgaggatccagttggccgagggctctgctggtcaggtctcaaggaacctgcttgcaaatgaggccgtccgttctttccacacccctttccaccgccggcttgcgcaccccaaccacacccccctcccaccctccagcccccccatatcagacctttttactctccctctcttttccgccgacccacctttccccccccaaacctgtttttacacctcccttcctccccgcacccacactcccaatcaccccttaacatatccccccccttcccgtcctcctcccgtcgctcctcggaccctgaacgtgccgtcctttgccccagcc

SEQ ID NO: 5416 - DNA, 522 bp, Zea mays
atgacagaagagagagagcatgctttatctgatctggaagtggttcccggccgggtcgccgcggccgttctggtcggcgtgttggcggaatccattattgccgccgccggcgtgcgcgtcggccgagctcttccggcgccgctcgttgtggccggccagacgcaggcggcagctgcgcttgacgtcgtcgaactccgacagctcgtggaaccggctgcattgctggcagaagcgctggcggaggccggcgacgagcacgacgggggccttggagtgcgcctcgcacaccttgtgcctccggttgtacggcttctcctcggtcatcaggttcgcgttgcaccgctccgcctggcacctcggcccgccgccgccgcctgccgcaacgacagacgccgccgccgccgccgccgcgcccctcctcaccgcggccggggaggaactggtagctccccctcccaagccggccgtcttagagaatcccccggggggcccaactttacacggaccaactttttttgtaaa

SEQ ID NO: 5417 - DNA, 774 bp, Zea mays
  misc_feature (401)..(401): n = any nucleotide
atggccgacaagaggtggttcatgggagtgttcggggtagccaaaagcttccgggccaccgatgtccaggtcggggggcggcgaccgggcacgccgatggccttgaccccgtccatgctccgggcgaggtcgaggtcggcgccgaggtacgcgtccgactccgcgaagaacgtgtcgacgccgctgtcctcgtggctgttgtcgggctcggggagcagccatcgacgccgcctcggcctcgctgctcccgtagtcttccgccaccgcttccccctgagctgggacctcggcccccgcggcggcagcgaaggccggggacgggaagggctgcggcgcgtccgcgagcgcgccgaagagaggggcgacggggaggcgctcgtggcggcgcgcgagcgggttgnccgagtggatgtcggcgtcgcaggcggcgcacagcgcggcggcgtcggcgcggcaggtgacggcggcgggggcatgctcgcagacctcgcacagccagacgcgcgcgtggcgcgacccggcgccgtgcgcccgggcgtcgcagccggggcacaggaacgcgccgtccgcgcggcagtgcagccgcgccggctccgcggcgcacgcgtcgcaagggcgcgcgcccaccacgctccagtaccccgccgccggcttctgctccaactccagccccagctccagctccgccgcggtgtccatgcctctgctccgggagtcacgagagagatgccacgggtgtcggtgtcaccagagacacgggcggactgggttgcg

SEQ ID NO: 5418 - DNA, 345 bp, Zea mays
atgggcaactgccaggcggcggaggcggcggcggtcatcatccagcaccccggcgggaaggtcgaccggctctactggtccaccaccgccgccgaggtcatgcggaacaacccgccacactacgttgccctcgacatactccgtgttcctgcagataataagtccgccgccgccgccgtcgccgccgccggccactttgagccgttacccatccccgttcctgtcgtcctatcgttttccttatccacatacccgtacactatttaccacatcattcttttcctgcccttcttctcctttcctcttacaactcgctcaaacctattatcttatatatcattaata

SEQ ID NO: 5419 - DNA, 669 bp, Zea mays
atgtccttcagcgatgacgaaccgatcatcccttctccaaactcagggccgaggccgacgccgatcgtgcccgggagggtgcagctggtgagcaagaacaacaacatggctccactggaggagaatacccagaaggtgctgcttgagctgaccggcggcgactccaccagcgaccggtcggggcttgacctggtggccgtgctggacgtgagcggcagcatgcagggcgagaagatcgagaagatgaagactgccatgaagttcgtggtgaagaagctcagctccatcgaccgcctctccatcgtcaccttcctggacaccgccaacaggatctgcccgctgcggcaggtgaccgaggactcccagccgcagctgctgaagctcatcgacgccctccagcccggcggcaacaccaacatcagcgacggcctccagacggggctcaaggtcctcgccgaccgcaagctcagctccggtcgcgtcgttggcgtcatgctcatgtccgacggccagcagaaccggggcgagccagccgccaacgtcaagatcggaaacgtgccggtgtaccccttcgggttcggcgcggactacgaccccacggtgcttgacgcggtgggcaggaaaaggcatggggagggaccttcttcgtcgccaacgacgggaacttgc

SEQ ID NO: 5420 - DNA, 621 bp, Zea mays
atgccccccagacacaggcatgcactcccaaagcccaaccacataaacggcctagctagaggctatcgcggcgaccgagcctttccggcagcgtacgtagcagcagcccaccgccctttaagggccatatgccgccgcgccggcagtggttcaaggaggtcgcgcgcgcggtccgctcgagtgtggttcttctctcaagacccctgcgcctggtcgatgcggtgctgtgctgcatccttgatgtcgcgggccttggacgccagcctcgccttggcgtggtccagctggtcggcgcccggcgggtgcttgcccgtcaggtacttgtacatccaggagaacacggacagcgcagcgacgccgaggccgccggaggtgacgaacccggccgccatgagcgccagcgcgatggcggccggcaccagcaccgggctgaagatcaccagcacgggggtggccaccgtgagcgcgatcacggtgccggccaggatcagcccggacagcaccagcatcgacccgccgaaggtggcggccgtcgcggccttgagcgccgtcatcatggcgccctgcttctgctgctgctgcgcctcgccgtgcatgccgcccccgcgctggaggtcgccg

SEQ ID NO: 5421 - DNA, 1215 bp, Zea mays
atggccgccgagatcatccgctacgggccctcggacgtcgcgttcgtgccctacggcgagtactggcggcagggcaggaaactcctcaccacgcacatgctcagcaccaagaaggtgcagtccttccgccatggccgacaggaagaggtgcggctcgtcatggacaagatccgcgcggctgccaccgccgcgccgccggcggcggtggacctgagcgatctcctgtccgggtacaccaacgacgtggtgtgccgcgcggtgctgggcgcgtcgcaccggaaccaaggccggaacaggctgttcagcgagctgacagagatcaacgtgtccctcctcggcgggttcaacctcgaggactacttccccccgaatatggccatggcggacgtgctcctccggctggtgtccgtcaaggcccggcggctcaaccagaggtggaacgacgtgttcgacgagctcatccaggaacacgtgcagagcaggccctccggcgagagcgaggagagcgaggcggacttcatacacgttctgctctccatacagcaagagtacggcctcactacggacaatctcaaggccatcttggtggacatgttcgaggcaggtatagagacatcttacctgacgctagagtacggcatggccgagctcatcaacaacaggcacgtcatggagaagctacagacggaggtgaggacgacgatgcgctcgccggacggcaagaagctggacatgctagcggaggaggacctcggcagcatgccctacctcaaggcgaccatcaaggagacgctgcgcctgcacccgccggcgccgttcctcctcccgcactactccaccgccgactccgagatcgacggctacttcgtcccagccgggacgcgcgtcctcgtcaacgcctgggcgctcgggagggaccgcacgacgtgggagaagccggaggagttcatgccggagcggttcgtgcaggaaccgggcgccgtggacgtccacatgaagggcaaggacctcaggttcatcccgttcggctccggccggaggatctgccccgggatgaacttcggattcgcgaccatggagatcatgctggccaatctcatgtaccattttgattgggaggttccgggctctgcagcaggggtgtccatggacgagtcctttgggctgacgcttcgccggaaggagaagcttctccttgttccaaggattgcttcc

SEQ ID NO: 5422 - DNA, 492 bp, Zea mays
atggcggcggctgatgtggagtaccgttgcttcgtcggcgggcttgcctgggccaccagcaacgagtcgctggagaatgccttctcctcctacggcgagatcctcgactccaaggtcatcaccgaccgggagacggggaggtcccgcggcttcggcttcgttaccttctcctccgagaactccatgctcgacgctatcgagaacatgaacggcaaggagctcgacggccgtaacatcaccgttaaccaggcccagtcccgtggcggcggcggcggcggcggcggctacggaggcggtcgcggtggcggtggtggttatggtggtgggcgtcgcgacggaggttatggtgtaggaggagactacggcggtaggaccaaacgcgatggagtagagatatctatagagcgtagtcaaccgcctattgccacaagtatctcaactaaatctactcgcctcctcttaatacttacatcatgctcccattcgtctcgc

SEQ ID NO: 5423 - DNA, 192 bp, Zea mays
atggctgacttggcaaggccagtggccgtgcccaccaggccggcctggcgaacctccttcgcagccgagcgggccaaggttggggcttccttcaccactggagggacgcggcggtctatctcctcaacggactcaccaaccttgcggtcgatgaacttgaggaggtcgagcgggacggcgtggaaacggtcg

SEQ ID NO: 5424 - DNA, 666 bp, Zea mays
  misc_feature (465)..(465): n = any nucleotide
  misc_feature (477)..(477): n = any nucleotide
atggcgcccaggaacgctctccccgccgccagcgccgtggccaacggcatggtgatggagccgaggttccgcggcgtccggaagcgcccgtggggcaggttcgcggcggagatccgggacccggccaggaaggcgcgcgtgtggctcggcaccttcgacaccgccgaggccgcggcgcgcgcctacgacgccgccgcgctccacttccgcgggcccaaggccaagaccaacttccccgtcgcgttcgccgcgcttccgccgccgccgccgcccaagaagccggccgccgtgaccgtgagccccagcagcagcagcaccgtggagtcctcctcctcctcctcccgggactcgcccgccacgccgcccaggcccgcgtctccgtcccagcaggccccgtcgctcgacctcagcctaggcggcacaccggccatggtggccgcccagccgttcctcttcctggaccgnaggctcgcggtnaccgtggccgtgccggcgcccgtgccctaccggccgaccgcggtcgccgccggtgccaacaagcatgctgcggcatcctgccgtgaagaggagcagagcgacaccgggtcgtcgtcatcccgtggtggacgcctccccagcggtcggcgtgggttcgacctcaacataccgccgccggccgaggtggcg

SEQ ID NO: 5425 - DNA, 249 bp, Zea mays
  misc_feature (223)..(223): n = any nucleotide
atgaaccgtggcgactggctcgcgctcgtcgccgtacactctgactcgtggctcgtctccgtcgcattctactacgccgcgcggctcaaccgcagtgatcggaagcgtttgttcggcatgatgaatgatctgccaactgtttttgaagtcgtctcccagtggtgtgaagcaatcaaagagagggatagatccggtactgacatggtggtagaaataaactgtncggtaagcaaacaagcgagccacgat

SEQ ID NO: 5426 - DNA, 246 bp, Zea mays
atgggcgccaacggccacccaccgctggcgagcacccgcgcgcacaacgggtcccactccggcggaagcggaggcggaggaggtgggggagggggagcgaaccctagcaacggcggcacggcggcggcgcttcggcacgaccctggcctggcgcgggagtggttgacggaggagcatgccatccttgacgaactgctggtcaagtatgcatccgacttacctgtcgttcgttatgcaaaattgcaa

SEQ ID NO: 5427 - DNA, 546 bp, Zea mays
atgtgcgacctagtggcccgcacgggccggcatcagcagcgatacgaggatggccgtcggctagtggctggatgcataccatttaggtatagagctaacaatgatgaaacctctggtgacaaaactaagaaactcgtggaagttctcatgataaattcccaaagcggacctggtcttttgtttccaaagggaggatgggagaatgatgaaactgttgaagaggcagcagctcgagaagctatagaagaagctggagttcgaggtgatatagtgcattttctggggctctatgacttcaaaagcaagacgcatcaagatgcgtgctgccctgagggtatgtgcagagctgcagtgtttgcgctgcatgtaaaggaagagctggcctcatggcctgagcagagcacccgacagaggacctggctcacggtccctgaagctgcatcaagttgccgataccagtggatgcaagaggccttgctgacaggcttctctgactggcacgacaagtggagcagaggcggcggcggcacaaactgtgacccggcc

SEQ ID NO: 5428 - DNA, 861 bp, Zea mays
atggaggctgcggcagcggcagcggcggcagctccagcgcctgcgggggagagggaccccgagcaccaccacggatgtctggccgtcaggacgtcgctgccgcggtgcgccatcggcgccggcggcggctcctcgctgcctggatcttccgatgaaacatcatgtggatcaccgagatggatagggagaggcctctcgtgtgtgtgcatcaagcggaaaggcacatatgaaaggatatgcatgaacctcacaccagtgcaggaagaaaggcttcagagattgaagcatcgcatgaaggtttactttgatccatctagacgagatcaccaggaagccctgaaagctctttggcatgcaacataccctgatcaagaacttgaaggtttgatatctgagcagtggaaggacatgggctggcaaggaagagacccatcaactgactttagaggcgcaggattcatatccctggagaatcttttgttctttgccaagacgttctccgcatcgtttcagagacttctaaataaacagtgcggtaacagagccacatgggagtacccatttgcggttgctggtgtaaatattacattcatgatcatgcagatgctagatctccagtctactaagccaagaacatttgtgcgagccatttttatccaaatgctctcagaggatgagtgggcatttgatctgctctactgtgtcgcatttgttgtgatggacaagcagtggctggacaagaatgcatcttacatggacttcaatgaggtgctgaagtcgacacgagcccagctggagagggagcttatgctggacgatgtcatccgcatcgaagacatgccgtcatacagcctgctttgc

SEQ ID NO: 5429 - DNA, 561 bp, Zea mays
atgtactcgaagtgcttggtggtgccgatgttgccgtcgtcgacgaggcggatgggcctgcggaggtgcggcctgctctcgatcttggtcagcgagatgccgcggaaggcgaaggcggagagcaccttgaagagcacggaggtgccctccctgtcgtgcgcgaacacgatgctggtcttgaaggggcggtccgtgcgcggcacgatgggctcccgggccagcgtcacgaagcgggtcacgttgccggagtcgtcatggatgccgtccggcagcacctccattccgtacagctcggcggcgcgggaggaggcgatggcggccgtgtcgcggaggccgttggcggccacgtgctcggcggcgccggccgtgtcgtcgaaggcctcgcggaccacgttcaggcccatgcctgtcagcgtgtgctcgcactgcgccagcgcctgcgggtggctgatcacgcgggtcaggcactccttgcgcaccccgggcagcgccagcaggcagtggtgcacggggagctgcacctccccgacgatgtggagccggtgccggagcagcaggtcg

SEQ ID NO: 5430 - DNA, 546 bp, Zea mays
atgaaacccaagatatcagattttggaatggcaaggatgtttggaggggaccaaaaccaattcaacacgaatcgggtcgtcggtacatttggctacatgtctcctgaatacgcaatggaaggcattttttcagtcaagtctgacgtctatggcttcggagtcctgatcttggagatcatcacaggaaagagggctgtgagcttccactgtcacgaggactccttgaacatcgctggatatgcgtggcggcaatggaacgaagacaatgctgcggagctgatcgatccagtgataagagcatcgtgctcagttcggcaggtgctgagatgcatccatattgcgttgctgtgcgtgcaagatcacgcagatgagcgacctgacatccccactgtcatccttatgctgagcaacgacagctcgagccttcctaatccgaggccgcctacgctgatgcttcgaggccgtgagatcgaatccagcaagtcaagcgagaaggaccggagccactccattggcactgtgacaatgacacagttgcatggaaga

SEQ ID NO: 5431 - DNA, 195 bp, Zea mays
atgcggaggttcaagggaacaactttggcgacacgccgcggcggcctcagtcggtggccgcggccacgtcgaggacgagagtcgcggcgggtgccggggcctccgcctcctccacgtccaccgtggcgccggaggcgacgagcgtccagtccggcgggagcggcggcagcggcgggtactgcgtggggcggcgct

SEQ ID NO: 5432 - DNA, 570 bp, Zea mays
atggtgcagcaagccgcgaaggaggtgatcccgctgctgacgccttacaagatggggcagttcgagctctctcaccgggtggtgctggcgccgctgacgaggtgccgctcctacggcaacgtgccgcagccacacgccgccgtgtactactcccagcgcgccaccaggggtggcctgctcatcgcggaggccacgggggtgtcggccaccgcgcaggggtacccggagactcctggcatctggacgcaggagcaggtcgaggcgtggaagcccatcgtcgacgccgtccgccgcaagggcgccatcttcgtctgccagatctggcatgtgggcagggtctccaccaacgagctccagccgaacggcgatgcgcctatctcgagcacggacaagcagatctccccggacgccgagtccggaacggcgtactcgaagccgcgccggctgcggacccacgaggtctccggggatcgtcgacgacttcaggcgggccgcacggaacgcgatccaggctggcttcgacgcgttcgagatccacggcgcgcacgggtacctcctgggagcagttca

SEQ ID NO: 5433 - DNA, 204 bp, Zea mays
atgtccatgttggggagcaggcgcgcctctaggatccagaggtcgaggtcgccatgcaggaggacgggcttcgctggagactcgccgccggccggcgacgccatcgccggcgacggagcctcgcggtcggggccggtgccggccgccggggcacgggagaggcggcggcgagcgtctatgcaaccaaccagagcactccaatcc

SEQ ID NO: 5434 - DNA, 510 bp, Zea mays
atggacacgcacgtcggcaaattaatcgactcggtgggctccatcttccgcggcagcgacgtcctgccctggtgcgatcccgacatcatcgccggtttcgagagtgaggttgctgaggctgcaaatgaagaacagaaaaccgagagcctgatgaggctctcctgggcgcttgttcactctagacagcctgaagatgtcaaccggggcatcggaatgcttgaagcttcattggacaggtctagcagcccagaggaaacaagggagaagctctacttgttagctgttggtcgttacagaactggggattatacaagaagccgacagcttttggaaagatgcttagagatccaacatgactggagacaagccataactttgcaaaggctcgttgaagaaaaaaccaaaagagatggtatgattggcatggctatcatcacaggcgcctttggagttgtgggtcttgttgctggtggtataattgctgcggcttcttcgtcatccaggaagaga

SEQ ID NO: 5435 - DNA, 435 bp, Zea mays
atgggcagcaacactggtggtgccagtggtggcttctaccagcccttcaacagcaacttagctggtgcaggggctagcactggcatccaaaactttccaggtgtacggctgcgaggtctcccttttgattgcaatgacattgatatctgcaagttctttgtgggactggacatagtggactgcctcctggttaacaagaatggtcgcttcactggtgaggcttttgtggtcttcccaacagctatgcaaacagaatctggtctgcatcataacaggcagaacatgggccggaggtatgttgaggtgttcagatgtaagaagttggagtactaccgtgcaatagccaacgaggtgagccagggtggttactttgagtcggagtatcgccgctcctcacctcctctgaggccaaaacgcgtgggtcgacgactctcg

SEQ ID NO: 5436 - DNA, 105 bp, Zea mays
atgtgcgagtccacgtccagcatgtactccaccacctcccgccgcagcggcggctcagcgcgccccagccgcgccgccaccatctgcatcgcctggaaccggagg

SEQ ID NO: 5437 - DNA, 504 bp, Zea mays
atgggctcggaggcggactgcgacaggatcaggggcccgtggagccccgaggaggacgacgcgctgcggcggctcgtggagcggcacggcgcgcgcaactggacggcgatcgggcgcgagatcccggggcggtcgggcaagtcgtgccgcctgcggtggtgcaaccagctgtcgccgcaggtggagcgccggcccttcacggcggaggaggacgcggccatcgtccgcgcccacgcccgcctcggcaaccgctgggccgccatcgcgcgcctcctccccggccgcaccgacaacgccgtcaagaaccactggaactgctcgctcaagcgcaagctcgccgccgcgtccgccccggcgggttcctccgacgtcgaggcgcgcccgaccaagcgcgtcagcctctcgcccgacagcccgtcggggtcggggtcggggtcagggtcagggtccgggtccgggtccgggtccgaccgtagggacttgacccacggcccccgcccaggt

SEQ ID NO: 5438 - DNA, 411 bp, Zea mays
atggcggattcgaaggccgctgcggcggtgacgctccgcacacgcaagttcatgaccaaccgtcttctctcccgcaagcagttcgtgctcgaggtcatccaccccggccgccccaacgtctccaaggcggagctcaaggagaggctagcgaagatctacgaggtgaaggacccaaactgcatcttcgtgttcaagttccgaaccaacttcggaggcggcaagtccaccggcttcggtctcatctacgacaaccttgaggccgccaagaagttcgagcccaagtaccgcctcatcaggaacggccttgctaccaaggtagagaagtcacgaaagcagatgaaggaacgtaagaacagggcgaagaaaatccgtggtgtgaagaagacaaaggctggagatgccaagaagaag

SEQ ID NO: 5439 - DNA, 783 bp, Zea mays
atgagtcgaacgcagtgggagtccttcatttgcatgctcatgacaggggtggatgatccagagacggtttatgaggttaatggcaaccagatctcaaagacaatccagtttttaggagtgagatttgagtccttcaacctcagtgtggagttcttccggtccgttttccttgtgcagcagatccctgcgcttcgccatgggcgcagaagggtccgtgccatcctgaagcttgataagttggatggtttaagtcaggaatgggtgaactcagatgttcttattttcaactcagggcattggtggactgccagcaaattatttgacatgggttgctattttgaggctggaggtgtgcttaaactgggaacatccattaatgctgctttcaaaatggcattggaaacttgggcttcatgggtgaaagagagaattgatttaaggcgaacacatgtattcttccgtacatatgaaccgtctcattggagtggcttaaatcaaaaggtgtgtgaagtaacacaacaacctaccgctgaggccaatggaaatgacaggagagaatttggggatatacttgctggtgttgtggcaaatatgagtgtccctgtgacagtactaaatgtgactttgatgggggcctttagaagtgatgctcatattggactttggagtcatcctaataccatactagattgcagccactggtgccttccaggagttcctgatgcttggaatgagcttgtattttcgcaccttttgactaatggttggcgagtgccggctagc

SEQ ID NO: 5440 - DNA, 294 bp, Zea mays
atggcgtccgccacatcggcgccgcccgccacctccatgacgtggctgcgcagcgcgttggggctgtcgcgcgtgacgaagatgggcggcttgggcttgttcttggaccccggcgggcgcccgcggggccgccggctgggcgccgccaccacggcgccaccggactcgttggtctcatcggctccgtggtcgcccggcgcgccgactgccgggctgctgggctccgggtccttcatggccgggggctccgtcttggggttggggccgccggacggctgctccggcaggcccaag

SEQ ID NO: 5441 - DNA, 510 bp, Zea mays
atggcctcggttccggctccggcgacgacgaccgccgccgtcatcctatgcctatgcgtcgtcctctcctgtgccgcggctgacgacccgaacctccccgactacgtcatccagggccgcgtgtactgcgacacctgccgcgccgggttcgtgaccaacgtcaccgagtacatcgcgggcgccaaggtgaggctggagtgcaagcacttcggcaccggcaagctcgagcgcgccatcgacggggtcaccgacgcgaccggcacctacacgatcgagctcaaggacagccacgaggaggacatctgccaggtggtgctggtggccagcccgcgcaaggactgcgacgaggtccaggcgctcagggaccgcgccggcgtcctgctcaccaggaacgttggcatctccgacagcctgcgccccgccaacccgctaggctacttcaaggacgtgccgctccccgtctgcgccgcgctgctcaagcagctggactcggacgacgacgacgaccag

SEQ ID NO: 5442 - DNA, 333 bp, Zea mays
atggcgccgccgcagccaaagtcgggccttttcgttggcatcaacaagggtcatgtcgtcaccaagcgcgagctgcctccccgcccgtgccaccgcaaggggaaatcaacgaagagggtgtctatggtcaggggcctgatcagagaggttgctgggtttgctccttatgagaagcgtatcactgagcttctgaaggttggcaaggacaagcgtgccctgaagcttgctaagagaaagcttggaactcacaagagggcaaagaagaagagagaggagatggcgggcgtcctcaggaagatgaggtcggctggtacgcacactgacaaaaagaaa

SEQ ID NO: 5443 - DNA, 762 bp, Zea mays
atggcggccccggcgcctcacgtcgcggtgagcgccgccgccgtcctcctcctcctcccgttcctcctcgcgcccctcgccgtcgcgcagccgcccaagagcgccaaggcgttctgcattagccagttcgccatcgctagccaggcctgttctatcctgccgccgagtccacccgacgagcaccaccaccacgacgatgaggacgacgacgacgacgacgagcatgatgaccgcagcgaccgccgcagccaccacgcggcggccatcagcatctcgggcctgctggcgagcaataacggcagccacggcgtcgtctctgggaaccgcaccgttggtcaccacccacaccaaggcaaccgcacccgcggcgggcacgggcgcgggcgcgggcgaggccgtgggcgtggccgacgtgggcgtctgcgggatgacgacgacaaccatgacgccgacgatcctgaccacgacgatgaccatgacgacgatgatgaccacgacgaccaccatgacaccgacgacccagatcacgacgacgaccacgacaatgatgacgacgacgacgacgacgatgaccacgatcacgaacaccacgacgaggagctccgcgcgtaccgcgactgctgccgatggctcaaagaggtgcagaaggaatgcgtctgcgaggcgctgctgcggctgccccccttcctcgtcaagccgcagcacacttacgttgtcagggtcggcaggacgtgcaatatcacctaccgctgcggcggcgtc

SEQ ID NO: 5444 - DNA, 141 bp, Zea mays
atgcattcttcaaagcaattgttgctttttcccatatgtcatcagtgccaacagatttttctggtctggttgaaaggtttatctcataataccgaaaaccaaattgtccaagtatttgctcagttagatcaagaacacctc

SEQ ID NO: 5445 - DNA, 447 bp, Zea mays
atgcagcagcgcaactacgggagggaaggattctcgcatataactgtcacaggtgctcttgctcacgggacgaaggaggtggaagtgtggctacaaacatttggtccaggtcaaaggaccccaatccacaggcattcttgtgaagaggttttcattgtcctcaaggggaaaggcacgctcttactcgggtcgagctcgctgaagtacccaggacagccgcaggaagttcctgtctttcagaataccacattttcgatccctgtaaatgatccacatcaggtctggaattctaatgagcacgaagatttgcaagttcttgtgatcatatcgcgcccaccggtcaagatatttatatacgatgattggagtatgcctcatacagctgcaaagctgaaattcccctacttctgggatgaggactgcttgccagcaccaaaagatgaactc

SEQ ID NO: 5446 - DNA, 657 bp, Zea mays
atgggggagaagacggagtaccgggacggcccgctggagcgcgcgttcatggggctgttcgcgcgcaagatggagaagtacgcggcgaagaagccggcggcgcaggcgaaggaggagagggcggtgtgggagtgggactacgagagcttcgtggacgtgtcgcggcgggtgatgctggggcgcacgcgcgcgcagcagcagcaggcggtgcgcgaggtgctgctgtccatgctgccccccggcgcgccggcgcagttccggcggctgttcccgccgacgcggtgggcctgcgagttcaacgcggcgctgaccgtgcccttcttccgctggctcgtcggcccctcggaggtggtggaggtggaggtcggcggcgtccggcagcgcagcggggtgcgcatcgagaagtgccggtacctggagagcagcggctgcgtggggatgtgcgtcaacatgtgcaaggtccccacgcaggacttcttcaccaacgagttcgggctccccctcaccatgaacccaaatttcgaagacatgagctgcgagatgatatacggccaggtgccgcctccgttggaagaggacccggcgtcgaagcaagcttgctacccgagcctctgttccatgtcgacgccatctgccccggcctgtccgaagcttcag

SEQ ID NO: 5447 - DNA, 978 bp, Zea mays
atggccgacaacgcgaaggccgcggcggcgcatgcgaggccggagtcgtcgcaggaggaggaggaggactggaaggaggccgagggggacgtcgccgaagtcgaccgcgccgccaccaatggcgccggcgaggggggcgtgcccacagacaggccgatccgggtctacgccgacggcatctacgacctcttccacttcggccatgccaagtcgctggagcaggccaagaagtcgtttccaaacacatatcttcttgttggatgctgcaatgatgagttgacacataaattcaaaggaagaactgttatgactgaggatgagcgatatgagtcacttcgtcattgcaagtgggttgatgaagtcattccagatgctccatgggtggtgacagaagagttcttggataagcataacattgattttgttgctcatgattctctgccgtatgctgatgctagtggagctggtaacgatgtttatgaacatgtaaaaaagcttggtaagtttaaggagactcagcgcactgatgggatatcaacatcggacattataatgcggattgttaaagattataatgagtatgttatgcggaatctggccaggggctacactagaaaggatcttggtgttagttatgtcaaggaaaaacgactgcgagtgaacatgggacttaaaaacctgcgtgacagagtgaaacagcaccaagaaaaagtaggggagaagtggagcacggttgcaaaactccaggaagagtgggtggaaaatgcagaccgctgggtggctggtttcttagagaagtttgaggaagggtgccactcaatggggacagccatcaaggagaggatccaggagaggctcatcaaggcacaatccagcgactttggcagcctcctacagtacgacagctacgattctgatgaagccaaagaaaacgacgaggacgaagacgaagatgaactctttgaagacgtcaaggaa

SEQ ID NO: 5448 - DNA, 1239 bp, Zea mays
atggccgccgccgccaccacctcctcatcctcccacttgctcctcctctcccgccagcaggcggcctccctacgatgccgcctctccttcctcggccagcccgccagaaggtccggcagggtcacggcccaggcgccggccgctaaggacgtgcggtgcatggcggccgtggacactgcggcgtccgcggcggcggcggagacgagccccaagtcgagcagctacgagatcgtgacgctcacgacgtggctgctgcagcaggagcggaccggcgcgatcgacaacgagatgaccatcgtgctggccagcatatccacggcgtgcaagcagatcgccgcgctggtgcagcgcgcgcccatctccaacctcacgggcgttcagggcgccgtcaacgtgcagggcgaggaccagaagaagctcgatgtcgtctccaacgaggtgttctccaactgcctcaagtcgagcgggcgcaccggcgtgatcgcctcggaggaggaggacgtgcccgtagcggtggagcagagctactccggcaactacatcgtcgtgttcgaccctctcgacggctcctccaacatcgacgccgccgtctccactggctccatcttcggcatctacaaccccaacgacgagtgcctcgccgacgtcgacgacaacgacacccttgattcggtggagcagaggtgcatcgtgaacgtgtgccagccggggagcaacctgctggccgccggctactgcatgtactcgagctcggtgatcttcgtgctcaccgtcggcaccggggtgtacgtgttcacgctggaccccatgtacggcgagttcgtgctgacgcaggagaaggtgcagatccccaaggcgggcaagatctacgccttcaacgagggcaactacgcgctctgggacgacaagctgaagctgtacatggacagcctcaaggagcccggcgactcggggaagccctactccgcgcggtacatcggcagcctcgtcggcgacttccaccgcactctgctctacggagggatctacgggtaccccagggacaagaagagcaagaacggcaagctgcggcttctctacgagtgcgcccccatgagcttcatcgtcgagcaggccggtggcaagggctctgacggccaccagagaattcttgacatcacacctacagagatccaccaaagagtgcctctgtacattgggagcgtggaggaagtggacaaggtggagaaattcctggct

SEQ ID NO: 5449 - DNA, 285 bp, Zea mays
atgtcactgttaccactttcctcaaagatctgcatcagccaagttttgatggatttacttttgtctataactgtttcacttccaacctccaagcgaccgattaacttgggatcaatcttgtattttttcagcagagaattgacaaccgtcaaactcattgagatgacatcctccacctcgctgcaaaaggccatgcaatcttgcccaagcccaatggtgtacttccctttgctcgccccatcatgggcctcaagtgcctcctgctgcacgcaggagggcgggaag

SEQ ID NO: 5450 - DNA, 423 bp, Zea mays
atggcggagcggacggcgcagtggtggaggatgttggagttcacgaacgagacgccggtcgtggcgccgacgtcggccgcgaaccccgcgacgcgggcgttgttgagccggatcacgaggtcgtgcgcgtcgatctgcgcgccccggccggagccgagaagggtgccgctgttcccgacgacggcgcaggtcggggcgcgccggcgccggcgctggccgaggaggagggcggggaggtcggccatggcgcccgcgacgtcgtcgccgcctcggcggtggcggtggcggtggcgcgcgaggaggaagccgcggagggatgcgcggaaggcggcgaggagggcgtcgtcgttggggacgtcgtggaagggaatgcggagacgggacactgtccgctgccgcggcgcggaggtggcgttgatgcgg

SEQ ID NO: 5451 - DNA, 390 bp, Zea mays
atggttatttcgataccgcaggggttccaaaaaataaactattctagcgtttcaacgtttggatttgaagctatctgtgaccctcctcagtctttccaccaagacaggaatgtcctcctcactcaatgttgtgaagcaacacctgaaccatccaggctcaatgcaatggcaagaagaacctggggtaacgttgacctttgcttcctccaacagcctatcccagagcttgcgctctcctttctcgctgtaagatcggatgtacctgctcatgtctgcccagcaatagaacccgccgctgctcttgaagcattctatcccaagttgtttcaaagcatcagaaaacagaaggtacattttccggagcctctctctggtaacctttatgtattc

SEQ ID NO: 5452 - DNA, 267 bp, Zea mays
atgtcgagccggaggccgtcgtcgcgtggcaacatctccgaggacgagatcaacgagctcatctccaagctgcaggccctgctccccagctcccgccgccgcggctccggccaggcgtcgacgacgaagctgctcaaggagacctgcagctacatcaagagcctgcaccgggaggtggacgacctgagcgaccggctgtccgacctcatggccaccatggaccacaacagccccggcgcggagatcatccgcagcatcctccgctcc

SEQ ID NO: 5453 - DNA, 504 bp, Zea mays
atggacgaggacttcgagatgcctcccgccggcgccgatgagatgatgggcgacgacgagatgggcgacttcggcggcgacgagggcccggtgatgaaggtgggcgaggagaaggaggtcggcaaggaggggctcaagaagaagctgctcaaggagggcgagggctgggagactcccgaggtcggcgacgaggttgaagtgcattacacgggcacgctccttgatgggacaaaattcgactcaagccgtgatcgtggagaacccttcaagttcaagcttggacaaggtcaagtgataaagggttgggatcaaggaatcaagaccatgaagaaaggagaaaacgctattttttaccattcctccagagctggcttatggagcatctggttcaccttcaactatccccacccaaggcaaccctgcagtttcgaatgcgagctgctttcatgggacccacggcaaagaaattttgcaaagagggcggcattattcaagaagaacctt

SEQ ID NO: 5454 - DNA, 969 bp, Zea mays
atgtcgtcgttcggacgcaattcatggtgtatcctcgtgctggcctccgtgctcctcctgtcctgcctcgccgacacggccgtggccaagcgaacaggcgagctcaccgtcttctggggccggaacaaggaggagggcacactgcgtgaggcctgcgacaccgggctctacaacaccgtcatcatctccttctacagcgtgttcggccacggccgctacgccctcgacctctccggccacccgctggacggcgtcggcgccgacatcaagcactgccagtccctgggcatcccggtcttcctctccatcggcggcgggggaaaccactactccatcccttcctccgcgtccgcggaggccgtcgcggacaacctgtggaacgcgttcctcggcggcggcaacagcgacgtgccccgccccttcggtgacgcggcggtcaacggcatcgacttctacatcgacgaccacagcgcaccgggcgaccactacgacgagctcgcgcgccgtctcgactacttcaacagcatgtactaccacgccacgacgaagtacgtacggctgacggcgacgccgcggtgcgcgttcccgcccgacgaccccatggcgcgggcgctgcggacggggctgttcgagcgcatccacgtccgcttctacggcgacgccgacaagtgctcgtacaagaacggcgacgtgtccggcgtcgtggaccagtggagcaagtggacggcgaggtaccccaagagccagctttacgtggggctcgccgcggccgagagcggcgtgccggaccacgcgccgccccccgttgaggtctacctcaaatacctctactacgatctgctgcccaaggtgcagaaggcgcccaactatggtggcgtcatggtctggaataggttcaccgacaacaggaccggatacagcggcgccgtcaagggctgggcggcttgcagctatgctggctgtgttaac

SEQ ID NO: 5455 - DNA, 969 bp, Zea mays
atggtgcagcaaacgctggggatgtcgctgccgatggcggcgttcgtgcccgagcagggcagcgccaataggctgaccaggccgccggggctgccgccgctgccgcaggcgttcgcggcccagcagcgcggggacgtgtgcatggaggccgtcgaccccgcggctggcccgcgcaaggcgcaccggcgctcccgcagcgacgtcccgttcggctacttcccgccggcgggccaccaccagctcccgccgcccaaggtggaggccggctggggcggccacctccccgccggcggcggcggcggcggcgacgacgacctgttcaacgcgtacctcaacctggaggggctggacgggctcaactcctccgacgaccgcctcgacgacggggacagccgcggcagcagcatgaggaccaacggcgccgacagcagcgagaacgagtcggaggagtgcgccgccgacagccgcgccgggatccgcctctgcgccgccgctgccgacaggcgggaggggctcaagagggccgccgctgcgcccgtggcgcgccacgccaggagcctgtccatggatagcctcatcggcaagctcaacttctccgccggcgcgacgggcgccgctagcggcgtcattccgggacccaacaggttcagcctcgagttcggcaccggcgagttttcgccggtcgagatgaagaagatcatggccgacgagaagctggcccgagatggcgctcgccgaccccaagcgcgtcaagagggtgctggccaacaggcagtcggcggcgcggtccaaggagcgcaagatgcgatacattggcgagctggagcacaaggtgcagatcctgcagacggaggccaccactctctccgcccagctcacgcttcttcagcgggactccgcggggatcgcgacgcagaacaacgagctcaagttccggctgcaggccatggagcagcaggcgcagctgcg

SEQ ID NO: 5456 - DNA, 657 bp, Zea mays
atgcgcctggaccgatactggtgtgcacgcgcaacgacgacctcgacgccgtgctcgaggccacccccaagtcgcgctggcgcgaatggaatgctggatccatggtttaagatcaagggcctagtgggtgcaaaccaggtgttggcctacttcgctgtatcaaaggttggagagccaccagtcgatgggattactgataccaacccagaggggttgactgctgcatttggcagctgggctcctgcagtggctgcccgcctgcaaaatggtggacttacctgcaaggtgcttgaaaaggaagcctttcagaagcagatgctagagaagttgatatggatttcagctttcatgcttgttggtgctcggcatccaggggctactgttggtgtggtggaaaagaattaccgatctgaggttgcgagcctgatagctgaattagcatcggctgcggctgcagaggagcagctcacattcgccgaaggcatggaggatcggctctgtgcttactccagggctgtggcacacttccctacagctgtgaaagagttcaagtggaggaatggctggttttactccctcaccgagaaggcgcttgcagcaggaaagccagatccttgcccactacacacagcttggctcaaggagattagggtcata

SEQ ID NO: 5457 - DNA, 612 bp, Zea mays
atggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttgctgtgtttggctgcaggaaccctgaggagatcccatggggttcggttggcgctgaatatgttgttgagtctactggtgttttcactgaccaggagaaggctgcagctcacttgaagggtggtgccaagaaggttgtcatttctgctcctagcaaggatgcccccatgttcgttgttggtgtcaacgagaaggagtacaagtctgacatcaacattgtctctaatgctagctgcacaaccaactgccttgctccgcttgctaaggtcatcaatgacaagttcggtattgttgagggtctgatgaccactgttcatgccatcactgctacccagaagactgttgatgggccctcatctaaggactgcgaggggtggaagggctgc

SEQ ID NO: 5458 - DNA, 498 bp, Zea mays
atgcgaagcatggggttaaaagacagagacaaagttgtaacgccttcggatcgtcacttattttttcgcttctttccgggcttcagcttgataacctcgtcaatgtacaggatccccttccccttgtacacctctggagccttagagctccggatggcgccggcgaactggtgcaccctgtccttatcgatgccggtgcagcagattatgttgggtttgaagcagaagacacggacagctggaggagcggtgaactgcacctcatggctgaagcccagtttaaggaacaactcacggccttggctctctgacctcgctttgaagccgaccccaacgagcttcaggaaacggaaaaacttggcttccattgagattaaatggcgagctcttcaaacagcctgcaggccggctgctggcgccgccgcgccggggatggaggaggggacgatgccgccgtatcccccgtcaccggtagcgcgccgccgtcacctgttccgc

SEQ ID NO: 5459 - DNA, 1431 bp, Zea mays
atggcggagccgggcaaaagagcggtggcgcagtggcggcggtgggcgctggccaacctgggcccgttcgcggccctgttcaccaccaacttcggctcggcgtggctgatcctggcgccggtggtgtcgctggtggccacctacgcgccgcggcggctgttccggacctacttcaacctgttcctccgccggcgctcccgccgcctgctcaacgtcgtggacccctacgtgaccatcgacatctcggagcccggcggcgaggtgcgctactcgcgctacggccccgtctccgacaacgacagcacctacgaggaggtgaaggcgtacctgagcggcgccgcgcgcgagcaggacgcgcgcgagctccgcgccgagggcgcccgggagggcaacggcctcgtcgtcagcatgcgcgacggccaggacgtggccgacgagttccgcggcgtcccgctctggtggtcctccgtggtcgccagggacgtgcagggccagcgcaagggcgaccggcgcttccagcggctcaccttccacctgagccaccgcgcgctcgtcgtcgacgagtacctgccccacgtccgccgccagggccgcgagatcctcttcagcaaccgccgccggaggctctacaccaacagcaagtcacgcgactcctacagctacgagtacaagtcgtggagctacatcgacttcgaccacccgaagacgtttgacacgctggccatggaccgggtcagaaaaggacatcatccacgacctcgacacgttccggaacagcagggagttctaccggcgcgccggcaagccgtggaagcgcgggtacctgctgtacggcccgccgggcacgggcaagtccaccatggtcgccgccatggccaactacctcgactacgacatctacgacgtggagctcaccgtggtgcacaccaacagcgacctccgcaagctcctcatcgacaccaccagcaagtccatcatcgtcatcgaggacatcgactgcacgctcgacgtcaccggcgaccgcgccggcaggccgcggcgccgggccaacggcggcggcgacgccgacgacaggccgcgcgactcggtgaccctgtccggcctgctcaacttcatcgacgggctctggtcggcgtgcacgggcgagcggatcgtcgtcttcaccaccaaccacgtcgagaggctggacccggcgctgatccggcgcggcaggatggacatgcacatcgagatgtcctactgcaggttcgaggcgttccagacgctcgccaagaactacctggacatcgacgaccacgacgacctgttcgccgccgtcggggaggtactacgggaggagaacctcacgccggccgacgtcgccgagtgcctcatggcggccaggcgcgctggctccggcgagccttccccgtgcctccagatactgatcga

SEQ ID NO: 5460 - DNA, 402 bp, Zea mays
atgttcagagaggctcgaacagagatgattgagagtctcctaaggatatatagctgttgctcaaactcagcctctgatcttgagctcttggtaacgaaaacctgctcaatgactggctcagtctcgagtgcagattcacccaagtctgagttgtcagtcggaaccagacgccacccgagtattacatgtcccagtgattctgcaaccttcataaactcagctttgcctttctcacgacgcttttcatctgttggcataaaaaacattccaacagcatactcgcctggtgggggtagctcaaacccagcatcctttgcgacctctttgaagaagtcatgtggtagagcgaccatgatgccggcaccatctcctgtattcttctcgcagccgcaggcaccacgg

SEQ ID NO: 5461 - DNA, 168 bp, Zea mays
atgaggagcgcttgttcttgcgggagccgccgcccacggggacgttgcggagggatccgccctccgtccagtagcggcggcacgtcttgcagaagtagcgtggctgctggaggctgtagttgttgtagtagcagaatttggtgttggtggagttgcaccgcgggcagt

SEQ ID NO: 5462 - DNA, 567 bp, Zea mays
atggacctcgccaagttctccccacctcagatcaagcgcatcctcagtgccgcgtcgctggagcgcgaggtgttcgacgcgctaatgctcgtgaagaagtttgggccggatgtgcgggaaggaaggaggagacagttcaattacatcggaagtcttttgcgcgatgcacaaccagaattgatggatactctaatacaagcttctaaggatggagatgagaggaagttatataccttacttagtgaaggtaaactgttggtggaagaagaggaagaggaggaagaggacctacctgatggagaagaggagaatcaagagtatatgaaaattgcagatagatggtttgacggcctcctctgcaaagacatttcagttactaatgaagtttactctgtccatagtgttgaatttgatcgtcaggagctgcggaagcttgtgaagagagcccacatgttccaagaaagcacacaaaataaagatggggaagaatctaatgcgaagctttctggagcaaagaaaccacttatgaggttccttcgttcccttgcaaaggaggcttatgctcca

SEQ ID NO: 5463 - DNA, 558 bp, Zea mays
atgaagaggaccacgagcaggagcggcgcgtcgcccgccgccggcctgtggctccggccgggccggctcggtgaggttctcgccgtcgcgactctgctggcctcggcgttgctgccgtccggcggcggctgcgaccgacgctccgccgcccggcgtcgtcgccgcggcacgactacgaggacgcgctgcgcaagagcctgctctacttcgaggcgcagcggtcggggcggctgccgcacggccagcgcgtcacctggcgcgaccactcgggcctcaccgacggcctcgagcaaggggtggacctggtgggcgggtactacgacgccggcgaccacgtcaagttcggcttgcccatggccttcaccgtcaccatgctctcctggagcctgctggagtacggcgccgacgtcgccgacgccggcgagctcgcccacgcgctcgagtccatcaagtggggcaccgactacttcatcaaggcgcacaccaggcccgacgagctctgggcagaggtcggcgacggcgacacggaccactactgctggcagcggccggaggaca

SEQ ID NO: 5464 - DNA, 702 bp, Zea mays
atgtcggagcgcgaggcgttggagcggcgcacggtgacgtgtatcctgccgtcctccttgacctcggcctccgtctcgatggcgtccctgcggccgtcgagggagaccacgtccgggtcgacgacgatggaggcgatggccccggcgttgtccgggaactgctcggtgatgagcatccgcgcgccgcggtactcgaacatgaagagcatgagcgtgtaccagatgatgcactggagcacgacgatctgcaccatgaggctgccggagaagtcgccgtacatgcccttgagcagggggatgcccatgacgagcgtgttgggcagcgtggagagggagaagagcgtgatggtccactccagggctgccccggcggctgaggtggctccacgcggtgagcatggccagcaccatgagcttctgcagcgtgtcggcggcgatgaagcgcaggttcatggtgtaggggttgttggtggagatgaagtggaaggacagcagcggcaccgcgaagagcgccacgaagcggttgatcccggagcactggtccggcgagaagatgcgccaccaccgcaccgacccgtaggccaggatcatcgccacgtacagcggcaccacggccgtcatgacgtggtagaagtccgtccccgtaatcatcttggagcgctctcacgacgctggctccctcactcacccagcagcccccgg

SEQ ID NO: 5465 - DNA, 573 bp, Zea mays
atggaaaattttggggggtcagtagcatcatatgatcagcaatatttgaagaacacaactcctgctgaatcctcatatagactatggtggtaccaagtttgcagtgaggttgcatatttccaggtggcaccaaaaaacgatagtgttcgttccccaaagatcgacacgaggtaccatttggacttgtgcagaaatgttttcggcgaaggagtctaccctgatgtctttatgacaaacttatactatggaggcacaggaattgcaggttctaaaattgtttttgcaaatggatctcaagacccatggcgccacgcttctaagcagaaatcatcagacgaattgccatcatacctaattgagtgcaagaactgcggacactgcagtgatctctctggatgccctcaagctccttcaaacattgaaggtgattcatccaagtgctcacctcccgaagctctgaacaaagtaaggaaggagattgtcgatcacattgacctgtggctatcagaatgccaagagcaaggacatgacaaggagccatggctgggaagcagatggagcatagctgctatt

SEQ ID NO: 5466 - DNA, 171 bp, Zea mays
atgccacgccggggcccgcgggacgcgggccgcagccggtgcactggctctggcacccggcgccgcagtactcggaggtgtcgccgcaaaagccgaagcggctgcagcagaggcagtcgcggcacgttgcgccgccggcctgctgcccgcactgctggccgctcgcgaccg

SEQ ID NO: 5467 - DNA, 660 bp, Zea mays
  misc_feature (625)..(625): n = any nucleotide
atggcggaaccggccctcctcccgccggaccccttcgcggacctccccttccccgaatttcaggcgcccatcgacggcgacagcttcgcgcttgaggacttcgatctggaggatctggacctggacgtggacttcgacctcgacctcttcggctcggacgggcaaccctcgcaaccgcccccgctcgcgacctcgtcctcctcggccgggtctccggttggaggctcgtcctcttccggtgccgtcggggacggcggagggctgaggaatgaggagtcttcggagtcgtcttcgaggagcgcgagcggcacggatggcagcggcaaggggaagggggaggaggacgaagcgaagcggcgcgcgcggcaggtacgcaaccgcgagagcgcgcacctgtcgcggcagaggaagaagcagtacgtggaggagttagagggtaaggtgaaggccatgcaggccaccatcgccgacctctccgccaggatctcctgcgtcaccgccgagaacgccgctctcaaacagcagctgggtggcgctgctggggccgcgccgccgccgatgccgatgtaccccacgatggtattctttgccgatgccgtggatgcacccatcgtatcccatgggntggatcgcaggtgccgctcgtgccaattcctcggc

SEQ ID NO: 5468 - DNA, 705 bp, Zea mays
atggccccgggggaggaggtggcggtggtggtagcggtggcggtggaggcggtggttacggaggaccaggctatgggtccggatcagggtatggtgagggcggtggcagcggaggtgctgctggagggtatggacatggtggtggcggcggcggcggtggtggtgagggtgcgggagctggtggctctgggtatgggtccgggcaaggatctggctacggagctggcagcggtgctgccggtggatatgggagtggcggaggtggtggaggtggcggtggccagggtggtggttccggatatggccatggaggtggtgaaggatacggctctgggtctggctttggtggtggtgctgccggcggcggcggtggacatggtggcggtggtggtggtggccaaggtgggtctggctatggctctggttcaggatatggatcaggtgaaggatacggacaaggtggtgctcatggaggaggctatggaagcggtggtggcggtggtggcggcggtggtcaaggtggtggtggctctggctatggatctggatccggctccggttatggaggcggcaacgacaacggacattattaggctctttttaagagctagatacatgttatacaaatatgtcaccagacatgagtctgtcttgttgcatgggatgctagctgtgtccatcgtgtgtgtaacaccgcaaggcttg

SEQ ID NO: 5469 - DNA, 624 bp, Zea mays
atgccgggccccacccaggcctccaccggtaacggcaccaccacgtccccgatcgagatcggcacacgagccccaccccgccggcccagcacagcccgcgtggcatgtgatacccgcggatacccacaccccgccacaaccccatccccccggcagaggcaggccgctccgcaccaacttctcgcccccgctcccccttcgtccatcccgttggcccccacccacagggactaccacccaccagatgcagatggtgatgtcgtccttcgacgcggtgcccggcgccggcgcggcgaggccgtacacggcgctggcgctgcagaccatctcgcggcacttccggtcgctgcgcgacgccgtcggcgcgcaggtgcagtcgctgcggcggagcctgggcgagaaggacgggtccgcgcagggaggcgggctgccccggctgcgctacatcgaccagcagctgcggcagcagcgcgccatgcagcagttcggcatgatgcagcagccgcagcacgcctggcgcccgcagcgcggcctcccggagtccgccgtctccgtgctccgcgcctggctcttcgagcatttcctccacccgtacccgaaagattccgagaagctgatgctcgc

SEQ ID NO: 5470 - DNA, 273 bp, Zea mays
atgggagggcggcggcggccggcggggccggcggtggggagggcggcggagctggactggtggtcaaggagcggattctgcccgtcgagctgcacaaggaggccacggaggcctacatgtcgtacgccatgtccgtgctgctcggccgtgcgctccccgacgtccgtgacggtctcaagcccgtccaccgcaggatactctatgccatgcatgagatgggccttgcgtctcgtaggccattcagaaaatgtgccagagttgttggtgaggtac

SEQ ID NO: 5471 - DNA, 939 bp, Zea mays
atggccggcgtccccgtcccgcccgatctcctccgccccgccccccacgccgccgccttctccttcgccagccccgccgcgtcgcccttctaccatcaccaccaccaccacccgtccctgagttactacgcctactacgggaagaagctggacccggagccgtggcggtgccgccgcaccgacggcaagaagtggcggtgctccaaggaggcgcaccccgactccaagtactgcgagcgccacatgcaccgtggccgcaaccgttcaagaaagcctgtggaatccaagaccgcctcctcgccgccccagctgtccaccgtcgtcaccaccaccaccacccgggaggccgccgccgcgacgccccttgagtccctcgcgggggcggggggtaaggctcacggcctgtccctcggcggcggggctggctcgtcgcacctcagcgtcgacgcttcgaacgctcactttcgctatggcagcaagtaccctcttggagctaaatccgatgctggcgagctgagcttcttctcaggagcaccagggaactccaggggcttcaccattgattctccagcagataactcttggcactccctgccatccaacgtgcccccgtttacactgtccaagggcagagactctggcctcctgcccggtgcctactcctactcccacattgaaccaccgcaggtgctcggccaggtcaccatcgcctcgctgtcacaggaccaggagcgccaccagtcgtcgttcagcagcggcggggccggcgctggtggattgctggggagcgtgaagcaggagaaccagccgctgaggcccttcttcgacgagtggcctgggacgcgggacgcgtgggcggagatggacgacgcgaggtccagtaggacctccttctcgacgacccagctctccatctccattccgatgcccagatgtgat

SEQ ID NO: 5472 - DNA, 744 bp, Zea mays
atgggaccgttctttggccttgttacagctcctctgctcggcaaggtacgggtagttggactcggtggtgacgcctccgttcctctggatgtactggaacgcgtagtccatgaggccgccgtcgcagccttggttgtccacgtcgtcgcagtccacgagctcctgctccgacagggacaccagcttcccggtcatgatcttgttgacgccctccacggccgcgatggccgagaacgcccagcagctcccgcactggccttggtccttgacgccggtgaccgcgccgcggagccgccagtcgaccgcgggcggcaggttcgtcgtcccgctcccgccccggccatgctgcgcgtgcgcgaagctcctcgcctcgcccagctgggcgcggtggtggcgcgtccgggagccagcgtacgtgcgccggaactcgtccgtggtcatgtccgcgaacttgttcagcgccagccggaacggccggccgtccttcctgttcgcctcgtggacgtaccgcgcgttctccttgaacacgttgaaccggcgcgcctgctgctgcttgtcgtccccgtcccgcggcgacaccctgtggtagtggctgcgccaccgctcgtacagcgctcgcaggctctcctccgacgccaggtcccgctcgctgaacgggatgccccgcgccgccggagccagtgcgagcgcggcgagcaacaccgcagccagcaccaggcacctcgacattgtgcggtgtgtgag

SEQ ID NO: 5473 - DNA, 939 bp, Zea mays
atggagaccatggctaagtacaaccgaagcaacccggcagtgaagcggatcctgcaggaggttaaggagatgcagtccaacccctcacccgacttcatggccctccccctcgaggaagacatcttcgagtggcaatttgctatccttggcccgagagacagcgagtttgagggtggaatctatcatggcaggatccagcttccctcggattatccattcaagccgccgtccttcatgctactcacgccaagtggacgctttgagattcagaagaagatttgtttgagcatatccaattatcaccctgagcactggcagccatcatggagtgtgcgcacagcgttggtggccttgattgcattcatgccaaccaaccctggtggggcattgggctcattggattacaaaaaggaagatagacgggcacttggtataaaatcacgtgaagcaccgccaaaatttgggtccccagaacgacaaaaactaattgatgagatccatgagcaaatgctcagtaaggctcctcctgtcccccaaacgctaccaaatgtgccaaacgaggagtctaacgaattacccgcatctgacccttctggcgagcatgcagacaaggtagatgaaggtgacaacacatctggttctgtatcagactcgtctagtggccttcctgtgcctgaatctgaatcgggggttacagaaaacactggtgaaacctcagcagttgaggttgccaaccatcatgtgcctgaagcaagccacagagagaacattccaagagttagttcgtctcaccagaatcctgctgttgcgatccagaagccaaatcatgacaggctgttgaccttggccgcatttgggctgactcttgctattatggcacttgtgatcaagaaattcttaaaaatcaatggcttgggcggtttcattgagggcaagttc

SEQ ID NO: 5474 - DNA, 450 bp, Zea mays
atgacgagaggcggggaaagctcagcagaggatggcctccatgctctccgtctgcacgcacaggcacacgggacacggcatggcgccgccgcagagggacagtgcctgcaggggaggagcaccacgaaggccggcctgaggcggcagcttaggcacgcgtggtctggcggcggccctgcgcagcgagggtccacgaatgccgacgccgacgactccgcctggctggccgacgtcgcccgctgtggcggcgagctcctcgaccgaccagctacgcgtgcagggcgaccgcggcagcctgctcggagagcgccttggcctgccacgccgtcgtctcgcctcggagacgcgctagccgctcctccagctcggcgccgcgccacgcctcgcgctccgcctccgccgcccagagggacaggtgcctgcaggggaggagcaccacggaggccggcc

SEQ ID NO: 5475 - DNA, 456 bp, Zea mays
atgtacctgcctccggcggtgttgtcgcccatcgcctcgtacgcgagtacgtgcgcctcggccaccgtctccacgttcgccgtggcgagcaggccgtcggcgagcattgcacgagcccctttgagatacgcgatggacgcggtggagttgcggcggcggaaccccgggccggtgacgagcgcggggcagatggtgaccagcttcaggtctcgtccccgcgccgccctccaggcagccttttccgctgccgtcttgccgagcgcaaaccacagcttgttgtcgcggcaaaagctctcgtcgctccagcagctctcgtcgatgatggtagggcaccgcccggccatgagggttgttctgcctccacacacatgccagcaaggaagaggtgaagacacatttcctgacggaccctgtcctgacgcaggcttcgatcacccgctccgctgcctgggcttc

SEQ ID NO: 5476 - DNA, 462 bp, Zea mays
atggatccatccgaagggtggagcactacgccatgcgtggttgacatgcttggccgagccagccagctggatgacgccaaggcgttcatagaagacggaccgttcaaggacagcgctcttctgtggcagtcgctgatgggagcttgcagcttccacaagaactcaggagttggtgaatgtgcggcagagaagttgctcctcctggaccctgactgcactgccgcttacgtcttgctctcgaacgtgtactcgtccgagggcagatgggacgacagggccaggatcatgaagaggatgagagctaggggcttgaggaaggacactggcaagagctggattgagctggaaaaggaggtccgttcttttgccgctgggccaacaaggtctcgccctgatgatgtgctggtgcagttgtccgcagttgccagtgatcaagaagatgtagtagagagcagtgctttg

SEQ ID NO: 5477 - DNA, 381 bp, Zea mays
atgagcgccatgacgcaggcggagatgatgaactgcattggcaacggaggggtggtccgcaacggcggcggcggcgcgcggaagcgcgacttccccgaggacgggtgcaccgagaagaccgtggagcgacggcagcgccgcatgatcaagaaccgcgagtccgcggcccggtcacgcgcccggaagcaggcgtataccgtggagcttgaggctgagctgaaccatctcaaggaggagaacgagcgcctcagagcagaggagaggacgattctgctgtcgaagaaaaagatgctggtggagaagatgatggagcaggcaagggagaatgtgagcgccaagaaggtcggtcccggactgcgccggtggggcagcgccatgtgg

SEQ ID NO: 5478 - DNA, 870 bp, Zea mays
atggctctggcgctggcccccatctcttccgcctcggccggcggcggcggcggcgccgcagcccccgggcagcagcagcagcacggcgggttctccatcggtagccccccgtccgaccccagcgccaagcgccgcggccggccccccggctccggcaagaagaagcagttcgaggccctgggttcttggggcatcgctttcacccctcacatcctcgccgtcaaggcaggcgaggatgttgcttcaaaaataatgacattctcacagcaaggccctcgcacagtctgcatcctctcggcgaatggcgcgattagcaacgttacgcttcggcagccagccacatctggtggactagttacttatgaggggcgtttcgagataatctcgctgtccggttctttcctgctcgcggaggatggtgacactcgcagcaggactggtggcttgagcgtcgcgctcgcgggatctgacggccgagttcttggagggtgtgtcgctggaatgcttatggctgcaactcctgtccaggtcgtggtggctagttttatcgcagaggggaagaaatctaagccagccgaagcgcggaaggtcgaaccgatggctgctcccccgccgccgccgccacagatggctgccttcgtgccggctccggtggccaccagccctccgtcggaggggacgtccagcgcgtcgtctgatgactccggcagcccgatcaaccacggtgcgatgccgttcagccactccagtcagcaccagcaccctcaccagcaccagcagcacatgccgcctgcctacgcgtccgggggctggtccctctcggtgcaccagcagaacaggcatgattctgacatgaagatgatgtcgaac

SEQ ID NO: 5479 - DNA, 222 bp, Zea mays
atgctgcactcgtcctccctgcccaccggcgccggcgccggcgtcgtcgccttcgccaggagccccgcggcggagcccgagcccgagacggcctcctccctgagcccgacctccgtgctggacgcggcggcggcctacgtgccacgcacgggcaagcggcgccgcccgtggcgcgcgcgggacaacaacggcggcctcgcggacgtgcgtggactgcaccga

SEQ ID NO: 5480 - DNA, 915 bp, Zea mays
atgcagatcttcgtgaagacacttactggcaagacgatcacccttgaggtggagtcctcggacaccatcgacaatgtcaaggccaagatccaggacaaggagggcattccaccggaccagcagcggctcatctttgctggcaagcagctggaggatggccgtacccttgcagattacaacatccagaaggagagcaccctccacttggtgctgcgtctcaggggtggcatgcagatcttcgtgaagactcttactggcaagacgatcacccttgaggtggagtcctcagacaccattgacaacgtcaaggccaagatccaggacaaggagggcattccaccggaccagcagcggctgatcttcgccggcaagcagctggaggatggtcgcaccttggctgactacaacatccagaaggagagcaccctccacttggtgctccgcctcaggggtggcatgcagatctttgtgaagacattgactggcaagaccatcaccttggaggtggagtcgtctgacacaatcgataatgtcaaagccaagatccaggacaaggagggcattccaccggaccagcagcgcctgatctttgctggcaagcagctggaggatggccgtaccctcgccgactacaacatccagaaggagagcaccctccacctggtgctccgcttgcgaggtggtatgcagatctttgtgaagaccttgactggcaagaccataaccctggaggttgagagctccgacaccatcgacaacgtgaaggcgaagatccaggacaaagagggcatccccccagaccagcagcgtctgatcttcgccggcaagcagctggaggatggccgcaccctagcagactacaacatccagaaggagagcactctccacctggtgctccgcctccgcggtggtcag

SEQ ID NO: 5481 - DNA, 156 bp, Zea mays
atgtcgcgcacccgggcgcccgccgtggccgcgaacaccagcacgcgcgcgcacgccgactccgaggccagcgcccgcagcgccgcggccagcggggccagcagcagcagcagcagcaggcgcggcacgccgccggcctcgaaggccaccagcgcg

SEQ ID NO: 5482 - DNA, 822 bp, Zea mays
atgcagctttcccacacggcgccacgcatgcaggagcccgggcgccggcccgtaccgccgttcgcgggcgtcgacctccgccgccccaggggctaccccgctccggcggcgaaggaggcggaggaggagccggccccagctccggcgccgggcggcgacccgtgcccgcggtgcgggtcgcgggacaccaagttctgctactacaacaactacaacacgtcgcagccgcgccacttctgcaagtcgtgccgccgctactggaccaagggcgggtccctccgtaacgtccccgtcgggggcggcacccgcaagagcggctcctcgtcctcggcctcggcctcggcaacgccaacctcgaccggcgccgcacccaagagcccgaggtcgtccaagaactccaagcgtcgccgcgtcggcccggccccggcgccggaccccgcccctgccaccgccaccgccaccgctgacgtcgcgaacacggcaccgtcgacggaagccgcagcagcaacgcgtgccgcctcggagaagccagccgcgacggaacccgcagcggcaacgggtgccgcctcggagaagccggccgcgacggagctcgcagcagcggttgtctccacagagaaacctccggcggccgtcggcggtttcacggacacgtctactacggtgcccgagatcgggctcgcggatgtctgcagcggcggcgtgaaggagcttgtgccggacccgggccacttcgagtggccgtcgggttgcgatctggggtcctactggggcaccagcgtgttcgccgacaccgacccggcgctgttcctgaacctgccg

SEQ ID NO: 5483 - DNA, 318 bp, Zea mays
atggcagagttcaagatcggtaggctggatggccagccaccaagggtcagaaatgtgcccattgccgtcaccccggaaggattctggtgctgcccatcacaggccgcgcttcagaagacagcgaagagcccaaaccagcagggcaggcctagagggggagcatcccctgcaccatcgaaggcatcctcggttcagagggtgccaaccatttcttcagagaagagagcacagtccactcctactaggtccagaacccattcagatgagcaagtgtggccctccagcaaatgctgttgcctgcccctgatccgccaaatg

SEQ ID NO: 5484 - DNA, 660 bp, Zea mays
atgtcgtgcccgcacgtgagcgggctcgccgcgctgctccgcgcggcgcacccggagtggagcccggcagccatccggtcggcgctgatgacgacggcgtacaacgagtaccccggcggcggcaacggcatcctggacgtggccacggggcggccggccacgccgctggacgtgggcgccggccacgtcgaccccgcgaaggccgtcgacccggggctggtgtacgacatcgcggcggcggactacgtggacttcctctgcgccaacaactacgaggcggcgcagatcgcggcgctcaccaggcagcacgcgtccgaggggtgcagcgccaaccgcacctacgcggtgaccgcgctcaactacccgtccttctccgtggcgttcccggccgccggcggcacggcgaagcacacccgcacggtaaccaacgtcgggcagcccgggacgtacaaggtggccgcgagcgccgccgccggcggcaccccggtgacggtgaccgtggagccgtcgacgctgagcttcagcagggccggcgagaagcagagctacacggtgagcttcacggcgggcgggatgccgtcgggcaccaacgggttcgggcggctcgtctggtccagcgaccaccacgtggtcgccagcccgatcgcggcgacgtggacc

SEQ ID NO: 5485 - DNA, 552 bp, Zea mays
  misc_feature (413)..(413): n = any nucleotide
  misc_feature (419)..(419): n = any nucleotide
  misc_feature (499)..(500): n = any nucleotide
atgggcggcagcgcggatgcgaacggcgcggggtcggtgcgggtgccggtgccgccggcgcggccgttcctggacacgttccgcgggaacctcaaggagaccttcttcccggacgacccgttccgcggggtggtgcgggagcgcggggccgggcggcggaccgtggccgcgctgcgctacttcttcccgttcctcgagtgggcgccggcctacgcgctgtccaccttcaagtccgacctgatcgccggcatcaccatcgccagcctcgccatcccgcagggcatcagctacgccaagctcgccaacctgccgcccgtgctcggactctactcgagcttcgtgccgccgctggtgtacgcgctgatggggagctccaaggacctggcggtggggacggtggcggttaacacagnaggtcngcggtcatggaagtcgaaatccgctacggagtgtggaacacctcaccctccggggtcactcagccccccgaatggctggnncctgaagcgcgccccccaccccccgccccttgggccgcgcgacatgccccgt

SEQ ID NO: 5486 - DNA, 777 bp, Zea mays
atgtactacccggctgaccagggggaagcgcccctcacggaggaggagcgcgcagagcggctcagggggatgaccaaggagataaacaagccgaacaccaggctacatggcagagccacggctgatgacgcgaggcccaaggaggagggggctgccatactttacgcgctagttgcaggctctactccgggagggatggcctaccacgaccctgacaagttgaagaagtacgatctggaggacctgaggaagaccccgaaccctttctacctcgagtcggacaagaaggccggcaacgggtacagttttgtgaggacgccgtcgccggcacccggcgtggacgagtcgccgttcatgacgtggggtgagatcgatggaacgccgctgaggctggactcggatgagacgccgggcggtagcgagagagcgcatttcaagatgccgccgcctcctgctcgcgatgtcaaggcgcacctgctttcgagggacgccgctcggaaaataaaggagcggtctaataccttccataggccgcccctaccctcccctgcgaggggtgtcagcgcaagccctagaaccctctcgcgggccgcacaaaaattcgtgaggaacgccatcaccaagtcggcaaagtcctccagcgccattgacgaatctctccgtgcaagctacagaggctcgaccccatctgcgagcactcccaagtcaaggttttcaaaagaccctggcctcgcatcgcgttctccatccacaaggcagggttccacccctccctgg

SEQ ID NO: 5487 - DNA, 909 bp, Zea mays
atggcccgtcgcgccgtcgccttgctcgtcgccgtcgcgctcgcgaccgtgctcctgcatacggcggaggttgcggcggggcagaagaagccggcgacggccgcgaggcgggaggacatcccctacatccggtgccaggtgtgcgagcggatcgcgcgcgagatctccgcgcaggtcgccaagaagcaccaggctctcccgccctccaagaaggtaccggagatcgagatcatcgaggtcgcggagaatgtctgcaacctaaagaagcaggaggcggattggatgcttcggatcgatatcgtcgagaaaggcgacaagctcgagcttgttgagcaagatgaggaagggcattgcaatgcagaatgcaagaccattgagcgtgcatgtcaggaggtgataggatatgctgataccgatgttgctgagtttgtatacaaaaataacccctcggtcgatcagcttatgaaatttctctgcaaagatctttcgaaagcatgtgccaaggacccaccgccagttccaaaagatcgtgtccctggggaaccatttgcaaggaagccatcaaaggatgctgagatggaaaagatattgagatcaatggagggtatgccgggagccccaagcatgaaaatgtactccagggacgatctgatgaaaaataactttggtactgaagacgacgacgaggaggatgatgaagatgaggatgacaacttcccaaagaacttggggaaagctctgaaaaacaagggctctcaaaagaaagatttgaaacagcaagtcgtgcagcagttcaaggataccagcaagaagttgaaagggcatgtaaacaaggtgtccggtatggtaaagaaatggtggaaaggggcaaagaagcctgccaaatccagcaaaagcaaaactgagctc

SEQ ID NO: 5488 - DNA, 552 bp, Zea mays
atgcgttgcatgcatgcagtacctctcgtacgtgggaaagcaatcaaacggaaccatgcatcactgaaacggaaccatgcatggaatggaagggaggcagcgcaaggcgatgatgagacggagaggcgctcagcacttgaagccggtgggcacggtcctgccgcagtagttgaggatgaggctgagatcgaccggcaggttgaggttgatgccgaggatgttgcccttgatagcagtgcagaggcaggcggcggcctccaggtcgacgagcccctccagcagcgggcagcatggctccgcgggcggcgcgcccaccttagccttgatgaggcccagcacgttggcgcacacgcccaacttgagcgcgtcgcgggggcacctgccgaacgacgacggcgtgggcgtcggcgtcggcgtcgagggggtcgagcagttgggcgtgcaggcgttggctacgcccagcaccaccaggttcacggccaggaacagcgcgaatgccttggacgccattgctcgatcacaacaagcagccagctacctcgcggatcacgc

SEQ ID NO: 5489 - DNA, 408 bp, Zea mays
atggacaggccaggccaccaccagcaccattttttcatgccgccgccgccgcagcagcagcagcagcagctttgcgtgccgatgatggacgacccgtcgtcgttcttggcggagctgatgggcgtcggcggcggaggcggaggtgggccgtcgtcgtccgcgaggggggagaggaagcggcggttcacggaggagcagatacggtcgctggagtccacgttccgcgcgcgccacggccacgccaagctggagccccgggagaaggcggaactggcgcgggagctgggcctgcagccgcggcaggtggccatctggttccagaacaagcgcgcccgctggcgctccaagcagctcgagcacgactacgtccgtgctccgcgccaagtttcgacgacctccacgcccgcg

SEQ ID NO: 5490 - DNA, 963 bp, Zea mays
atgcccaaatattccaagttcacacagcaggagctgcccgcttgcaagccgattcttactccaaaatgggttgtctctgttttcttaatcgttggggtcatctttgttcctattggtgttgtttcactgctagctgcaagagatgttgttgagattattgatcggtatgatgaggcatgtgtgccagttaacatgactgagaacaagcttgcttacatccagaatgagaccatatccaaagagtgcataaggaatcttacggttacaaaatatatgaagcagcctatttttgtgtattatgaacttgataacttctatcagaaccataggagatatgtaaagagccgaaatgatgcgcaactaagagatgctagtaaagctaaccagacatccgcttgtgaacctgagaagaccacagctaatgggcaaccaattgttccttgcggccttattgcttggagcttgtttaatgatacatataatttcactcgtggtaatgagaacttgacagtggacaagaaagacatctcctggaagagtgatagggagcataaatttggtaaagatgtctatccgagcaacttccagaatggtgcacttaaaggtggagcaacacttaacccaaagatcccgttgagtgagcaagaggacctcattgtttggatgcggaccgcagcacttccgacgttcagaaagttatatggcagactatactttgacctcaaggagaatgacacaataacagtgagattgaataacaactacaatacatatagctttggtggcaagaaaaagctggtcctctccactgcaacctggcttggggggaagaacgattttcttggctttgcataccttatagttggtgggctctgcattttcctggcatttgcattcaccttgctgtacttcgtaaaaccaaggaaactgggagaccacaactacttatcctggaacagacgc

SEQ ID NO: 5491 - DNA, 174 bp, Zea mays
atggccatgggacgcatacagcatccattgctgctggcaatcatggaattcctgttgttgtggctgggcatcaatttggaaatgcaagcggcatggctcctcgtgcacacattgctgtctataaagctctttacaaaagctttggtggttttgctgctgatgttgtggctgcaa

SEQ ID NO: 5492 - DNA, 399 bp, Zea mays
  misc_feature (93)..(93): n = any nucleotide
atgcacgctccgcccacgggccaccacaacagagacacggcgcctgcgttgcacagaaaccggcgcgggggcgcacaaccccagcaccaaacnccccgagcgggtgaaggtgacgaccggggaggcgtggtgcgtggcgaacgcgatggccggggagcatcggctccaggcggcgctggactacgcgtgcggccccggcggcgcggactgcaaggccatccagcccggcgcggcgtgcttcgagcccaacaccatggtcgcgcacgcatcctacgccttcaacgactactaccagcgcaagggccggtccatcggaacctgcgacttcgccggcgccgcctacgtcgtcaaccaggcaccgaagatgggcaagtgcgacctcccatcgacggtctgaac

SEQ ID NO: 5493 - DNA, 534 bp, Zea mays
atgggcgccgacacgtcggcggtcgacgcgcgcgggaggactccgctggacgtcgcgcgcgacaagggataccaagaagtggtggacgtcctggaacggtgggagctggtgatgacggcggcgaggcgaggcgacctcgggagcctcgagtccctgctcagcaagcgcgccggcgtccgcgggcgcgaccagtacggcctcacggcgctgcacctggccgcgatcaagggacacggcgacgcgatcgcgctgctcgccgggccgggatgcatggacgtcgagtgcgaggacgtggaagggcacaggccgctccacctcgccgtcgagggaggccacgcggaggccgtggagctgctgctcgacatgggcgccgacgccaacgcccggaccaggcgcggcgccacgccgctccagatggcggaggccatggggtacgaggccatcgctcagctcctgtgcgcgagaggtgcggaggtggccgccgcgtcggcgttgtgcgccgcgtcgtcgtcttcatcgtccatatcgtgcgcc

SEQ ID NO: 5494 - DNA, 1317 bp, Zea mays
atggctagttctctacttcagcagctgctgtctctgctgctgctcctgctgccctctcctcttcgtctccgggagcatctatcaggaaaccatgctgtcagcgccaacaacttccaccccatctttctggtagctggggtgagctgcagcgacctggaggcacgcctcaccgaggagtaccggccgtcggtgccgcactgcggcgccatgaaggggaaggggtggttcggtctgtggaagaacagttcggagctgctgtctcgtgactacgtgcagtgcttcgaggagcagatgagcctcgtctacgaccctgccatcaacgagtaccggaacctcgccggcgtcgagacgcgagtgcccaacttcggctccacaagagccttcagccacaagaaccccctcaagtcagactggtgcctcggaaagctgagagccgcactggaagacatgggataccgagacggagacaccatgttcggagccccctacgacttccgctacgcgccgccgtcccccggccagacgtccgaggtgtactcccgctacttcaaggagctgatggagctggtcgaggccgcgagcgagaggacccggaagaaggccgtcatcctcggccacagcttcggcggcatggtcgcgctcgagttcgtccggaacactccgccggcgtggcggcgcgagcacatcgagcgcctcgtcctggtcgcgccgacgctccccggcgggttcctggagccggtgcgcaacttcgcgtccgggacggacatcctctacgtgccagcgacgacgccgctggccacgcgagccatgtggaggagcttcgagagcgccatcgtgaacttcccgtcgccggccgtgttcgggcgcctgcaggcgccgctcgtggtcaccagggagcggaactactccgcgtccgcgcacgacatggagcgcttcctcgccgccgtcggctccggcgaggccgcggagcccttcaggagacgggccgtccccaagatgggcagcttcgcggcgccgatggtgcccatgacgtacatcagcggggtcggcaacaggacgccgctgcggctggtgttctggggcgaagacttcgacgcggccccggaggtggcggcgtacggggacggagatggcaagatcaatttgatcagcgtcttggcgtttgagaaggagatgcgtcggcagccggagcagaagaagcagttcaaatccatcaagatcaataaggcccagcattctacgatcgtcacggatgattttgccctgcacagggtcattcaagaaattgttgaggccaataatcagaagattccatcc

SEQ ID NO: 5495 - DNA, 693 bp, Zea mays
atgccggcggccatggcggctgcggcggcgcagaggctcctcgcggcgagcacgaaaatcatcggcgttgggcgcaactacatagcccacgccaaggagctcggcaatccggtccccaaggagcccgtcctgttcctgaagccgacctcgtcgtttctccacgctggtgtggccaccgccgccgtcgagatcccggagccgctcgagtcgctacaccacgaggtcgagctcgccgtcgtcatctcccggcgtgggcgcgacgttcccgaggcgtccgccatggactttgttggaggttatgcacttgctttggacatgacagcaagggaccttcagtctgttgctaagtctgcaggccttccatggactttggctaaaggacaagacaccttcaccccaattagtgcagtagttccaaaatcagctgtcactaatcccgatgatctcgagctctggctgaaggtagatgatgaactaaggcagaaaggaccgacaagcgacatgctattcaagattccttttctgataagctatatcagttccatcatgacattaatggagggtgatgtgatactaacaggtactcctgagggtgtgggtcctgtccgagtaggtcagaagattacagctggtataactgacctaattgatgttgagttcgatgttcagaggcgcaatcggtcattttccaca

SEQ ID NO: 5496 - DNA, 318 bp, Zea mays
atggccaccttcgagctgtaccggaggtccaccatcggcatgtgcctcaccgagacgctcgacgagatggtctccaacggcaccctcagcccggagctcgctatccaggtcctcgtccagttcgacaagtccatgacggatgctctggagaaccaagtgaagagcaaggttactgtcaagggtcacctgcacacctacaggttctgtgacaatgtgtggaccttcatcttgacagacgcaagcttcaagaacgaggaggccacggagcaggtgggcaaggtgaagattgtggcatgtgattccaaattgctcggacaa

SEQ ID NO: 5497 - DNA, 438 bp, Zea mays
atgtcacatagtcactgtgtgaaaatgtttttagacaggaagcgctcgaaatgtgccacaacttcaccgttttatccattgaagatgaaagtaagtactgggatttggaccagcagagatcaagcacatcttctgaatgccccacgaaggtccgaatcggcttttctgacagtgcaaacacatgctctggcaccattagccggtctgagctcacagacctacgaccctccaagaaccttgcccgacgcttcttctcacgattgctcccatccagactgctggccaaggctaatgttgtctccggtgaaccgttgcacgccatggcaacaagaggattgcacagtccgttctcctcgcgtttcctctcaaactcggacacttcccagacatggatcacgcagtcttccccagcactcgcgaggtaccggccatctggac

SEQ ID NO: 5498 - DNA, 591 bp, Zea mays
atgaagaagatgcggtcgacgacgaaggccggtctaaacgctcgaccagaccgaggtgcgcgtcggaaaaaccaaactcaagctcatcagcgagcacaggtaaagcccctggaaccggcagtggtggcggaggcacataggggggatgcgcctcgggcgcgaacgggctgtagggctcgtgcaccggggtcggcgggcgcaccagttcggcgcgggacggcgagtagggcgggtggagtggatccgtctccagcggcggcgcgtccgcggaggcggccgaggacgagggagacgacgaagacagcatcggagtgcccagcgcgaggtcggagccgagatcggggcgtggggcgcgcggggcccgggggagaccgaggtagaggttcagatccatccgtctgctgctccgcgccgcgtcatcggcggccatccggcgggcgagacgcccgccttaattgtagcgcgctatcacacctcttcctccgccggcgcggtcgcgaagctcacgccttcctagctccgccccaccatggcaggccccggcgcggggcccgcgcgaacaggctaaagaaaccgctggagttcggcgca

SEQ ID NO: 5499 - DNA, 258 bp, Zea mays
atgcatcaatttcacagcttccctcatgaacaccgaagaatcggcgcccttccaacgggggtcggaatccgggaaaatctgcccgatgtccggcagccccagcgcgccgagaatcgcgtccaccacgcagtgcagcagcacgtctccgtcagagtgagcctcgcagccgcggtcgtgggggatgtcgatgccgccgatgatgagcgggaggttgggctccaggcggtggaggtcgaagccgtggcccacgcggaacgg

SEQ ID NO: 5500 - DNA, 357 bp, Zea mays
atggaggagaacaggaacctgccgcaggaggcgttcgacacggtggagctcgccaaggctgccgtggagagcaagtgccccgggatcgtctcctgcgccgacgtcctcgccctcgccgcccgagactacgtccagctggtgggtgggccgtactacgcggtgaagaagggccggaaggacagcaaggtgtccctggcggggaaggtccgcggcagcctgccgcgggccaactcgacggtggacgagctcctgcgcgtgttcgcgggcaagggcctgggcgcggcggacctggtggcgctctccggcgcgcacaccgtcggtttcgcgcactgcgtacacctgctgtgccttctctac

SEQ ID NO: 5501 - DNA, 537 bp, Zea mays
atgcagcaggaccagcggaacaagacttctgcagaggtcgacttcttcacagagtacggggatgcgaaccggtacaagatccaagaggtcatcggcaagggaagctacggggtcgtctgctctgccatcgatctccacactcggcagagggtggcgatcaagaagatacatggcatcttcgagcacgtctccgatgccgcgaggatcctccgcgagatcaagcttctgaggctcctgaggcaccctgacattgtcgagatcaagcacattatgctgcctccctcgagaaaggacttcaaggacattttcgttgtttttgagctcatggagtccgacctccaccaagttataaaggccaacgatgacttgaccaaggagcattaccagttctttctctatcagttacttcgggccctcaaatacattcatactgctaatgtttaccaccgtgacctcaagcccaagaatattttagcaaactctaactgcaaatttgaaaatatgtggactttgggactagcccgagtcggcattcaa

SEQ ID NO: 5502 - DNA, 414 bp, Zea mays
atgtttcgctgctcttcctataatcctatacctcgcctacaaaattatagaaagtgcgtagggacacggaacaggaatcagagcgcaagcttgaggttgtcaggacaggagtcgctgacgtccggccgtcggtacggctccgtgcggacggcggcgacccgagccttgcgcttctccatgaaccgctgcagcgacgccttcctcgcaactggcaggtcagcgcccgcagacgcagagccggagacatggtcgcggcgcttggcaccgatcgcctctgtttctgcacgttccgctgctgcgccggcggcgaggcgaagcaggcccgccgccttgtcggcggggacgtcagcgagcaccagcacacgccctccgtacacgatggtcaactgcgccggcgccggcgccggcgccgcc

SEQ ID NO: 5503 - DNA, 627 bp, Zea mays
atggagccgtacgcggcgacgaagggcggcgagtccgacgccggcaccggcctggaagagtcgatgcggaagctggggctcggcgaggacgacgaagcgggggaggagaagcttccggagcggccgggcgaggcggactgcacctactacctccgcactggcgcctgcggctacggggagcgctgccgctacaaccacccccgggatcggccggctccggttaatggcgttgggaagaccacaggtatggagtacccagagcgccctggacagccactctgtgagtactatgcaaagaatggcacatgcaaatttggttccaattgcaagtttgatcatcccagggaaagtggttttgtacctgtcgctttaaacaacagtggattccctctacgtctgggtgaaaaggaatgttcgtattacatgaaaactggacattgcaaatttggaggtacatgtaaatccatcacccagaacttggttttcttacagagacgcctggcatgtacccaccagttcaaccatcacctatttcctccccacatccatatccacatcattccaactggcaaatggggaggcctgctgttgtgccagggtcatttttaccaggcccatatccaccaa

SEQ ID NO: 5504 - DNA, 630 bp, Zea mays
atgatgctgggaaagagatctgggcgcccgtcgccggcggcgcggcagcacatgcggcggaccacgagcatgacggagttcgcggcaccgcacgtgctggtagacgtcgcggaggaggaggaggacgaggagctgcagctgctgccggcgcacgccgaggccacaggggaggcggccgagcaggaggaccccctacgggtgggccatcggcggccgccgcggcggcccgggcgcgcggactggctgggcggcgtaccgcgcccgcgcggcgccggcacctggcggggcacgccggaactcggccgacttctcggctgccgagaccgccgcgttcctccgcgccctgcgggctctgcaacccgccgcctcggaccccggccgcgacaccttcatgtacaggggcgacacggcgttctgcagcctcgagtgccggcagcagcacatcacgatcgaggagtggaaggagaagtgcgcgctcgccacgccgccgacggcgccggcgtccgacccggtggtgccgctgccgcccagcggcgcgggctccgacaaaccaggcacgctcgccgccgcatcctgattagtcatgagggagggggtcggaggcgatcgatgatccgactccggctaagc

SEQ ID NO: 5505 - DNA, 519 bp, Zea mays
atggcgtgcgtgaaaaagaagaaaggggggcagaaacgcttcgacggttattcagccacgttaaccaattcatactctacaagggacaagttgttgtcttccttcactgtgaagctggctggctctgtagcctcaatccgcccccatttgtccactgcaagcctcattgatcctttgaacatgtcgattttggcattgcgcaagatcaccgtggcatcgggcttcagcaaatcaacttggtcgttgcgggcggtgaatacgatgacgccggtctcgtctccgacgaggcactcggcgatgcgcggcgcgcgggacgaggcggcggcgggtgcgcccgggcgcgcgcggcccggcacgggggtggcgctgacgaccttgacggtgagggtgtgcccgttagtgcccggcttgagctggtcgaccttggtgaagacgggcttccggagcgccggcttgtcgctaccgccctgtgccgccgcggtggccatcgccggtagtggggtggggtgggtggaggac

SEQ ID NO: 5506 - DNA, 660 bp, Zea mays
atgtgctacgcccgcgatacagagagcagaagcccaggggtgaaggaggcacacggcaagggcgccgacgaggaaggagaaagaggaaggggaacgggacaaaccgctcgccggagggttatacgccggacaaggcccgttccccgaacgggtagccccaggggccgcgcttcgccgaagccttcgaacaccttcgcggcggctccatcgcgttctccatcctcatcgtcatcgtcagcggagaaaaacagtcggcggcggatatcgctgcgggacctcataagccgcacgggcggcgactgcgcgggggcggcggaccaggcatcgtcgtcaggcaccgggagcgccgaggtcaccagcaggccgggtttctggccgccgtctatctggccatcgccgcgctcgtcgtccaataacttgccgctgccctgcccggcgccacagccgccgggccgccgctccgcattcatcggacagggccgcggcgccgggcggcggcggcggcggcagtgctcggcgcaccacgtcgctgccgtaccgacagagcctggttctcgggtgcctgggcttcggggctcgcagccggagctacggggctcgccaagtccacgcaccccctcttctcttcacgctgaacacgaaaagctagcaaacgaagga

SEQ ID NO: 5507 - DNA, 420 bp, Zea mays
atggcgagcggcagcatgaagagggagatcagcgagacccacgacaccctccgcttcggcctcaatgccggcgtcaaggccgacctcgcgccgccgcacccgctccagtccagcatccaatcggaggccaagttctgggcggacaagaagaagtttgggacagaggccatctacggatccgccttgaacatccgcaaggatctcgatgcccaaatcctctcaaggttccaaaggccccctggtgctttgccatcatctctgcttggatatgaggcactgacaggttccctagatgattttggttttgaagattatcttaacatgcctcaagattctgaaggtttccgtcaacctgacatgcaccacggaatggaggttcgccttggtttgtccaagggacctatctgccctagcttcagt

SEQ ID NO: 5508 - DNA, 585 bp, Zea mays
atgacatcgaacctcggcgccgagcacctcctcgctgggatggtgggcaagaactccatgaaggtcgctcgcgatctggtcatgcaggaggtgaggaggcacttccgccctgagctgctgaaccgtctcgacgagatcgtgatcttcgatcctctgtcccacgagcagctgaggaaggtcgctcgccttcagatgaaggatgtggccgtccgtcttgccgaaaggggcatcgctctggctgtgaccgacgccgcattggacatcatcttgtctctctcttacgatccggtgtacggcgcgcggccaataaggaggtggatcgagaagagggtggtgacgcagctgtcgaagatgctgatccaggaggagatcgacgagaactgcacggtctacatcgacgccgcgcccggtaaggacgaactggtctacagggtggaccggagcggcggtctggtgaacgctgagacggggatgaagtcggacatcctgatccaggtccccaccagctccaccaggagcgacgctgcgcaggccgtcaagaagatgaggatcatggaggaggacgaggacggcatggacgaggag

SEQ ID NO: 5509 - DNA, 960 bp, Zea mays
  misc_feature (960)..(960): n = any nucleotide
atgggaaactgttgccgctcgccggccgccgcggcgcgggaagacgtcaagtcgtcgcacttcccggcctccgccggcgggaagaagaagccccaccaggcgcggaacggcggcgggggcggcgccggggagaagaagcggctgtctgtgctcggggaggaggggtgcgacgttggcgccgggatcgaagagaagtacgcgctggaccgggagctcgggcgcggcgagttcggcgtgacgtacctgtgcatggaccgtggcacgcgggagctgctggcctgcaagtcgatctccaagcggaagctgcggacgcccgtcgacgtggaggacgtgcggcgggaggtggccatcatgcggcacctgcccaagagccccaccatcgtgtccctgcgggaggcgtgcgaggacgacggcgccgtgcacctcgtcatggagctctgcgagggaggggagctgttcgaccgcatcgtcgccaggggccattacacggaacgcgcggcggccgcggtcacgcgcaccatcctcgaggtcgtgcagctctgccatcgccacggcgtcatccaccgggacctcaagcccgagaacttcctcttcgccaacaagaaggagaactcgccgctcaaggccatcgacttcggcctctccatcttcttcaagcccggcgaaaagttttcggaaattgtgggaagcccatactacatggctcctgaagtcttgaagaggaactatggacctgaaatagacatatggagcgctggtgttatcttgtatattttgttatgtggtgttcctccattttgggctgagactgaacaaggagttgcacaagctattcttcggggaaatgtagattttaagcgagaaccctggcccaatgtttcagataatgctaaagatcttgttcggcagatgcttcaacctgatccaaagctcaggctaacagcaaagcaagttcttggn

SEQ ID NO: 5510 - DNA, 381 bp, Zea mays
atggctccatctccgcctcggcgtgctgcgctcctcctcgccacggtgcttctgctggcggcggccgggtccacccccggcgccacggctgctggcatcttccaggtgcgccgcaagttcaccgccggggtgggagggggtgctggcgccaacatcagcgcccttcgcgcccacgatggcacccgtcacggccgcctcctcgcagccgccgacctccctcttggcggcctcggcctccccactgacactggcctctattacacggagatcaagctcggacgccacccaagcactactacgtccaggtcgacaccggcagcgacatcctctgggtcaactgcatcacctgcgagcaatgcccccacaagagcgggctcgggt

SEQ ID NO: 5511 - DNA, 336 bp, Zea mays
atgccaacaccaacccaaaacagaaaccaggtgggcatggggcacaacccgcccagacccggcgccgtggccgtcaacatccccggactgcgccaagatcttgggctacgagtaccgggagagcgggtgagcggcgcagaacgaccgcgcggacgaggacgcgcggctttcggcggcgccgggggccggcgctgggtcccgccccacgaggtgctgcaggggcgggagcgcgcggcggcgtccttctccgtgcgcgagggcgccgggcgcacgctcaagggccgcgacctccgccgcgtccgcaacgccatctgggagaagaccggcttccaggac

SEQ ID NO: 5512 - DNA, 303 bp, Zea mays
atgcttgcgaggcagatgcagaagcggctcacggcagaggaaagggagcgcctgtacaccaaatggggcatttcgctggactccaagaagaggaagctccaggtcgctcgccggctctggaccgaggccgaggacctagaacatgtcagggagagtgcctcccttgtcgccaagctgatcgggctccaggagccagggcaagtcctcagggagatgttcgggctcagctttgcgccgcagcagcagccgccccctcgccggcgatcctccaatggctggagatacgggatcccttcgttcggc

SEQ ID NO: 5513 - DNA, 504 bp, Zea mays
atgcacgagttccggatggagaacccccacaccccgcccaaggaggattgggtcctgtgcagggtcttctacaagaagaaggcagacgccatggactatgctgactgcagcgaccaggacgccatcgccgtgcatgtgcctcgcggcagcgctgacccgggctactgctactcgcctcctccgttccccgcgctcggcggcagccaccaccacggcggctccctcaacgacgacttccacggcggcatggcgctgcttcagcagcagcagcacaacggcgttttcgacttccacggcggccagcctcaccctcacggcggcgggcggcggcctccttgccgggccgccggctacagccgtggggtcaagagacggcggcgatcagtgtggcagcggcgtgctcatggacctaggactcgacgaccactacgcctacaacagctacaacagcctgctgcagatgtgatctatcatgcaagcaagcaagcaagctatatagctagc

SEQ ID NO: 5514 - DNA, 393 bp, Zea mays
atgtcgtggcagacatacgtcgatgagcacctcatgtgcgagatcgagggccaccacctgacctccgctgccatagtcggccacgacggcgccgtttgggcccagagcaccgcattcccacagttcaagacagaggagatgaccaacatcatgaaggacttcgacgagcccgggttcctggccccgaccggcctcttcctcggccccaccaagtacatggtcatccaaggcgagcccggcgctgtcatccgcgggaagaagggatctggaggcataactgtgaagaagacagggcaagcgatggtggtcggcatctacgacgagcccatgacccccggccagtgcaacatggtggtcgagaggctcggcgactacctcgtagagcaaggcctg

SEQ ID NO: 5515 - DNA, 288 bp, Zea mays
atgctcacgtcctccgccgccaccccgtccggcagccgccacgcgaacccgtgcaccaggttcgccacgccggcggcgaccagcttcatggcgagatcgtacgcggggcagatgcgtcggccggacccgaacggcagcagctcgaagtgcgccccgcgcacgtccacagcggcggcagcacccaggaaccgctccggctggaacgcgtcgggcgcgtcgggccacgacgccgggtcgcgcgcgatggcccacgcgttcaccagcacgcgcgcgcccgcggggacgtcg

SEQ ID NO: 5516 - DNA, 147 bp, Zea mays
  misc_feature (82)..(83): n = any nucleotide
  misc_feature (111)..(111): n = any nucleotide
atgtcagttgggcaagaagggcacgtcttcacaatcttctgtgcccttagagtccgaccaccacggcttctttcccttatannaagactggctatcatatgccccaagcanacaagtcttgcaaaagttgtgggcacatggagatcg

SEQ ID NO: 5517 - DNA, 459 bp, Zea mays
  misc_feature (20)..(20): n = any nucleotide
atggcttactctcccttcanccgcaacatctgcaggggaaacccatcaccgtgtaccgcgccaaggaccgcgtcgacttggcccgcgacttcacctacatcgacgacattgtcaagggctgcctcggctccctggacacggccggcaagagcaccggcaccggcggcaagaagcgcgggccggcgccctacaggatcttcaacctcggcaacaccgcgcccgtcacgttgcctaacctggtgtccatcctggagaagcacctcccgcgtcaaggccaagaagaacgtggtcgagatgcccggcaatggcgacgtgcccttcacccacgccaacatcaccctcgccaggcagcagctcgggtacaagcccaccaccaacctcgatgtcggcctcaagaagttcgtcaagtggtaccagtcctactacggctacaccaggggatccaagaactcgcgacaa

SEQ ID NO: 5518 - DNA, 789 bp, Zea mays
atggaaggcggactgagcccggagcggcacgcggcggctgagccggtgcggtcgcggtggacgcccaagccggagcagatactcatcctcgagtccatcttcaacagcggcatggtgaacccgcccaaggacgagacggtccgcatccgcaagctgctggagcgcttcggcgccgtgggcgacgccaacgtcttctactggttccagaaccgccgctcccgctcccgccggcgccagcgccagctgcaggcgcaggcggcggcggcggcggcggcctcctcgtcctcgtcgggatcgccccccacgagcggcctcgcgccgggacacgcgacggcttcgtcgacggcggggatgttcgcgcacggcgccacctacggctcgtctgcgtccgcgtcctggcccgccgccgccgtcgtgcgaggggatgatgggcaacctggattacggcgggcggcgacgaccctgttcgccatctcgcggcagatgggctacgccagcggcggtggctccgggctcggggtcctcggcggccatcgcacaccacgagcagcagcagcagcagctttactactcgccgtgccagccagcagcgagcatgacggtgttcatcaatggcgtggcgacggaggtgccgcgggggccgatcgacctgcggtccatgttcgggcaggacgtgatgctggtgcactccaccgccggcctcctccccgtcaacgagtacggcgtgctcacgcagagcctgcagatgggcgagagctacttcctggtcacgaggggctactaggtagc

SEQ ID NO: 5519 - DNA, 615 bp, Zea mays
atggaggcgctgctcccgaggtccggcggcgtcatctcgccaaagatcagcacgatcctgcagtcgcacgtgtacccgcggttcggccgcgtgctgcgcgcgctcgcccgggtcaagtcggcgctcctcgacgccctcggcaagaccaagtggggcgcgcggcggcggaagcagcacgcgccctccatcgcccgcggccgccgctcgaagaagaggaagagcagcaagggcgaattttcgaagaagccgccgcacctcacctggtccggcggcctgtcgccgcttcgaggcgcggccgtggatgcgctggacgtggactaccacgtgtacccgtcctgtgactatgagtcggtgtggaacgcggtcgtcgtgcccgcggcgaccggtgagtactgtgggtacctgcgctggctcgaggaggagatgccggacgaggtgggggtcgtggaggaggaggaggaggaggaggtggaggaagacgacggcgtcgcctctggcggcgggaacgagatcgaccggctagcggagcagttcatcgcgaggtgtcgtgccaacttcttgctggagaagcaggagtcgtacgaccggcgtcaggagatgatcgccaggagcctc

SEQ ID NO: 5520 - DNA, 678 bp, Zea mays
  misc_feature (535)..(535): n = any nucleotide
atggcgaccccgctccgcgccaccgcggtcctcgcgtggggttccggggaggacgggcagctgggcatgggcgggaacgaggagaaggactggccccacttcgttgaggcgctggggccctacgccgtcaccgccgtcgtcgccggcagccgcaactccctcgccatctgcgacgacggccgcctgttcacatggggatggaaccaacgcggcacgctcgggcacccgccggagaccaagacggagagctccccgggccccgtcgacgctctcgcgggtttcaagatcgtccaggcggcgattggcgggtggcattgcctcgcagttgacgacaaggggcgcgcctacgcctggggtggaaacgagtacgggcagtgtggtgaggagcctgagaggaaggaggacgggacgagggcgctcaggagggacatcccgatcccgcagcggtgcgcgctcaagctcaaagtccggcaagtagccgctggagggacacattcagtagttttgactcaagaaggtcacgtctggacatggngacagccatggcctccgggtgatatcaagcaaatatctacacctgttcgtgtgcaaggccttgagaaagtgagggtcattgctgttggtgccttccctattttgcccctaccggagatggattttcgtgggcctgggcttttc

SEQ ID NO: 5521 - DNA, 840 bp, Zea mays
  misc_feature (750)..(750): n = any nucleotide
atggcgaacaggggcttgcatctggctctgttcctcgtccttctcgggctgtcgtccaatttggcagccgggcagatcctgttccagggcttcaactgggagtcgtggaagcagaacgggggatggtacaacttcctgatgggcaaggtggacgacatcgccgaggccggcatcacgcacgtctggctccctccggcgtcacactctctcgccgagcaaggctacctgccggggcgcctgtacgaccttgacgcgtccaagtacggcaacgaggcgcagctcaagtccctgatcgaggcgttccacagcaagggcgtgaaggtcatcgccgacatcgtcatcaaccaccgcacggcggagcaccaggacggccgcggcatctactgcatcttcgagggcggcacgccggactcccgcctcgactggggcccccacatgatctgcagcgacgacagggcgtactccgacggcacggggaaccccgacaccggcgccgacttcggcggcgcgccggacatcgaccacctgaacccgcgcgtccagcaggagctcaccggctggctcaactggctcaagacggacgtcggcttcgacgcgtggcgcctcgacttcgccaagggctactccgccgacgtcgccaaggtctacatcgacggcacccagccctgcttcgcccgtcgccgagatatggacctcgctggcctacggcggcgacgggcaagcccttctacgaccagaacgcgcaccggnaggagcttggggagctggctggaacccctcctgggcaaggcagtcccggccccacgttcgacttccccccaaggcatcctcaagtggccg

SEQ ID NO: 5522 - DNA, 549 bp, Zea mays
atggcgggcgaggaagagctcactgtaggcggcggcgtgcccatccggccgccgcggctggaagacgcggggctcgaggactgcgcgctcccgccggagtctatcgctgaggcattctccctcgctgccgcggccgtctcctcccgcctcgcccggctgcccttctccgaagactccgacgaggaggactgcgtctcggcaccacgcggaggaggctgcgtggatgacgccggactcgactgcggggccgcccccgtctcccttgtcggcggcggcgttgcgggcgtcggcagcgtcgacgaagtcgtggtcgtcggcggaggacgcggaggcggatacgaggacgcggtagtggtcggtgggcgcgcagaagaggaggatacagtcgtggtggtcgcggaacagcctagggacagggagaagaaactggggaaggatgatggatgtgtcgagggggtgcgagaaggggtcagtgaacccagacgggcgcaaggcgatgaagacggcgaggaggcggcagagaaggcgatcttggtgccagatttcgac

SEQ ID NO: 5523 - DNA, 555 bp, Zea mays
atgcctgctgctctgctacagggcgacgcacgtcccggctgccggctccggcggcagggcggcgtggctggggatgctcgcggcggagctctggttcggcttctactgggtcatcacgcagtccgtgcgctggtgccccatccgccgccgcaccttccacgacaggctcgccgccaggttcggagagcggctcccctgcgtggacatcttcgtgtgcacagcggacccgcggtcggagccgccgagccttgtcgtggccacggtcctgtcggtgatggcgtacaactacccgcccgcgaagctgaacgtctacctctacgacgacggcggatacatgctgaccttctacgctctgagggaggactacgtcttatacaagcactgacctatcgttctgcaggaggctctgctctctctccctcgcctctccccccccttacttcctcctctcccctttccgtaacgcctctgcctatcctcccatgctccccccggcctgcggccgcgcacccgacaccctcccatcccgccaacgacgccgggaggcctctcccg

SEQ ID NO: 5524 - DNA, 540 bp, Zea mays
atggcgcggcgatccgcccctctcctgcgccgcctcgtctccgcctcctcaccgcccgcgctgcagtccctcacggaccacgtcggcgtcctcgcgcggcgcacggtgacctacatgccccggcccggggacggcgcaccgcgcgccgtcacgctcatcccaggcgacggcatcggccccctagtcacgggcgccgtgcggcaggtcatggaggcgatgcacgcgcccgtctacttcgagacctacgacgtccacggagacatgcccacggtcccgccagccatcatcgaatccatccgccgcaacaaggtctgcatcaagggcgggctcgccacgcccgtcggcggcggggtctcctccctcaacatgcagctgcgcaaggagctcgatctctacgcctcactcgtccactgctccaacctccccggcctgcccaccaggcacgagggtgtcgacatcgtcgtaatcagggagaacacgagggcgagtactcggggctcgagcacgaggtcgtacccggggtcgttgagagcctcaagg

SEQ ID NO: 5525 - DNA, 591 bp, Zea mays
atggcggacgcgaagcagcagcagcagcagccacagcaggcggcagcggcagccaccggcgtgtggaagacggtcaagcccttcgttaacggcggggcctctgggatgctcgcgacctgcgtcatccagcctatcgacatggtcaaggtgaggatccaattgggtgagggctccgctggtcaggtcacaaggaacatgcttgcaaatgagggtgtccgttctttctacaagggtttgtctgccggattgctgaggcaagcgacgtacacgactgctcgtcttggatcctttagggttctaactaacaaagcagttgaaaagaatgaagggaagccattgcctctaattcagaaagcttttattggtctgactgctggagcaattggtgcttgttttggtagtcctgctgatctggcactcattagaatggcagccgactcgaccctgccagctgcacaacgacgcaactataagaatgctttccatgcactctaccgtatcagtgctgatgagggagtccttgcgctttggaaggtgcaggtccactgtggtgagagctatggcactcaatatgggtatgcttgctttcta

SEQ ID NO: 5526 - DNA, 603 bp, Zea mays
atggccgccggggaccttgaggtgctcaccgcgctcgacaccgcgaagacgcaatggtaccacttcaccgccatcgtggtcgccggcatggggttcttcaccgacgcctacgacctcttctgcatctccctcgtgactaagctcctcggccgcatctactacaccgtggaggggtccgcgacgcccggcaccctcccgccgcacgtgtccgcgtccgtcaacggcgtggccttcgtgggcacgctgtcagggcagctcttcttcggctggctgggcgacaagctcgggcgcaagaaggtctatggcatgacgctcatgctcatggtcctctgttccgtcgcgtcggggctctcgttcggccacaccccggcgtccgtcatggcgacgctgtgcttcttccgcttctggctcgggttcggcatcggcggcgactacccgctgtcggcgaccatcatgtccgagtacgccaacaagaagacgcgcggcgcgttcatcgccgcggtgttcgcgatgcagggcttcggcatcatggccggcggcctcgtggccatcgtcgtgtccgcgtcgttcaagggcaggttccccgccccggcctacgccgtc

SEQ ID NO: 5527 - DNA, 357 bp, Zea mays
atggcgccgggctgcagctgcagtgggcgcaggggaaggccggcgaggaccgcgtccacgtcgtggtgtcggaggagcggggctgggtgttcgtcggcatctacgacggcttcaacggccccgacgccacggacttcctcgtctcccatctctacgccgccgtgcaccgcgagctccgcggcctgctctgggaccagcgcgacgcgcaccccgaccagccgaccacgaccagcaccacggcctcagatcaccaggaccgccgccgccgccgcgcccgccgctcgagaccgccgcgcggcgccgacgatgaccagcggcggtggaagtgcgagtgggagcgcgactgctccagcgccc

SEQ ID NO: 5528 - DNA, 477 bp, Zea mays
  misc_feature (394)..(394): n = any nucleotide
atggcgacttcgtcgtcgttctctggccccggcgggtccccggcccacgcgtctccgggaggcggaggcggcggcggcggcggcggtggcgtggggtcgtaccaccaccaccggtcgcggttcggcgacacgacgctgaccaaggtgttcgttggcgggctggcgtgggagacgccgtccgaggggctgcgccagcacttcgacgtctacggagagatactcgaggcggtcgtcatcaccgatcgcgagaccggccgctccaagggctacggtttcgtgattttccgggacccggacgcggcggcgcgggcggtgcagaacccgaacccggtgatcgccggccggcgcgccaactgcaacattgcggcgttcggcccgccgcgggccgcgcagncgagagggagaggaggaggaggaggaggaggaggccgcgggccgcacgtggccgatcgagcggctcgggggtcggcggcggcc

SEQ ID NO: 5529 - DNA, 414 bp, Zea mays
atggttgatggcacagtttgcttgtcgattccgttggtcgtcttccccacagaatcctgccgttgcacttgttgctcttgcaaagcatccaaatcaacgacttcagatggaggagatttgtccgcagaggtcatattgttgaatgaatttattttgctgataatttcaaccagattctgcttatctggtatgggaggaatgctaggcactttaccgacgctagaaccatgcaagtgcgcaatcactgtaattagattgacaatatcctgcgtcctatttgctgcattttcttggtttccaggtagcagcaactgcgaagaacatctgctggcttgggtttttcttcttccgccggttgtggccagaaagcctacgccggcagctcctcttaccctcgtcaactccgcgagtggg

SEQ ID NO: 5530 - DNA, 681 bp, Zea mays
atggggcgcggcaagatcgagatcaagcggatcgagaacgccaccaaccgccaggtgacctactccaagcgccggacggggatcatgaagaaggcgcgcgagctcaccgtgctctgcgacgcccaggtcgccatcatcatgttctcctccaccggcaagtaccacgagttctgcagccccggaaccgacatcaagaccatctttgaccggtaccagcaggccatcgggaccagcctatggatcgagcagtatgagaatatgcagcgcacgctgagccatctcaaggacatcaatcgtggtctgcgcacagagattaggcaaaggatgggcgaggatctggacagtctggacttcgacgagctgcgcggcctcgagcaaaacgtcgacgcggctctcaaggaggttcgccataggaagtaccatgtgatcagcacgcagactgatacctacaagaaaaaggtgaagcactcgcacgaggcgtacaagaacctgcagcaggagctaggcatgcgggaggacccggcgttcgggtacgtggacaacacgggcgccggcgtcgcctgggacggcgcggcggcggcgctgggcggcgccccgccggacatgtacgccttccgcgtggtgcccagccagcccaacctgcacggcatggcctacggcttccacgacctccgcctgggc

SEQ ID NO: 5531 - DNA, 642 bp, Zea mays
atggggaggtcgccgtgctgcgagaaggggcacaccaacaagggcgcgtggaccaaggaggaggacgagcggctggtggcgtacatccggtcgcacggggaagggtgctggcggtcgctgcccagcgcggcgggtctgctgcgctgcggcaagagctgcaggctgcggtggatgaactacctccggccggacctcaagcgcgggaacttcaccgacgacgaggacgagctcatcatccgcctgcacgccctcctcggcaacaagtggtctctgatcgccgggcagctgccgggccggacggacaacgagatcaagaactactggaacacgcacatcaaacgcaagctcctggcccgcggcatcgacccgcacgcgcaccaccgcccgcaggcgctgcaccacgtggcagcagcagccctcgtcccggcccccgccgcgaagccgaagccgaagccggcggagtcgtccgacgacggcgggcgcagcagctgcagctgcagcggcagcggcagcagcgcgggggagccgcggtgccccgacctcaacctcgacctgtccgttggtccgccggacgcgcccacctcgccgccgccgccgtgcctgtgccaccgcgcctgggaagcgtgcggctgccaggcaggc

SEQ ID NO: 5532 - DNA, 534 bp, Zea mays
atggccactgccgacggcgagccccagcccgtggccaccgaccccgcccaggtccaggctccggcaccggcaccggcaccctacccttccccggccaagcgcaagcccgaggcggatgtggaagccgacgccaaccttgcgccccctaaagccgcgcgtcccgacgtcgacgaggaggccgccgctgtggccgaggctgccagggccagtgctcgcgcggctgacaagggtaagggcaagatggtagtcgaggaggaggaggaggaggaggaggaggaggaagacgacagcgaggagagcagcgacgacgacgagggcggcggcggcggcagcagcgatgacgacgagctcgttgaagacccgatggccgaggtagacctcagcaacatcctcccctcgcggacccgccgccgcgcccccccgcagcccggggcgtacctcgtcactccggaggaggctgccgcggaggacgacgacgacgacgctgacgtggttcctgaggaggatgagggagcggagggagaggagagcgat

SEQ ID NO: 5533 - DNA, 417 bp, Zea mays
atgaagggcaaggccaacgcctccaagaaggatgaggccaggctccgggccggcggcggcggcgccggaaagcgcaagaaggccgccgcgagcggcaagcccaagcgccctccctccgccttcttcgtcttcatgtctgaattcaggcaggagtaccaggcgcagcaccctggcaacaagagcgttgcggccgtgagcaaggcagcaggggaaaagtggcgctctatgtcagagcaagagaagcaaccctatgtggaccaagctgggcagaagaagcaggactatgagaagactaaggcaaatattgagaaggagagcacaagctcaaagaaggctaagactgatgacgacgatggctcgaagtccgaggtcgatgatgaggatggcggtagtgacgaggataacgacgacgacgag

SEQ ID NO: 5534 - DNA, 600 bp, Zea mays
atgagcatcgcgttcctggacccgggcaacctcgagggcgacctccaggcgggcgccgtcgccggggacacgctgctgtggctgctcatgtgggccaccgccatgggcctcctcgtgcagctcctcgccgcgcgcctcggcgtcgccacaggccgtcacctcgccgagctctgccgcgacgagtaccctgactgggcgcgccgcgcgctctggctcatggccgaggtcgccatggtcggcgcggacatccaggaggtcatcggcagcgccatcgccatcaagatcctcagccgcgggtacctgccgctctgggccggcgtcgtcatcaccgccttggattgctttatttttctttcgctcgaaaactatggggtgaggaaactagaagctgtatttgcacttctaattacaactatggctgtctcatttgcatggatgttcacagacactaaacccacggggaaagccttatggttggggtttggggtcaagagtgagctcagggggagaatggacaggggtggggttgggggggggccgcccgagggccgacggtggtttcgtgcccggcacgattgtgttcacggaggccggttagct

SEQ ID NO: 5535 - DNA, 936 bp, Zea mays
atgaagtacgccgaggccaaggcgctccgggtgggcaagggcggcgcgctcgagtgcgcagtgtgcctcagcgagttcgaggacgaggagcggctcaggctcttgcccaagtgcagccacgccttccacccggaatgcatcggcgagtggctcgccagccacgtgacctgccccgtctgccgctgcaacctcgaccctaacaaggataccagcagcgatgaacagcggcccgacagtttcccgccgatcccagtggcgagcagcatctcgagcgaaaccgcggtgtcgtctgggcatggaccgctacctgtggccgtggtgatcgatgtgatcaccgaggaggaggaagaggcgcggcggcaggaggcgctggagctgcagcagatagggacccagcggcgcgccatgcggtcgcggtcggggcgcaagccggtcccgacgcagctcgcccggtcgcactctacgggacactccctcgccgtccggctcgaccgcgacctggagcggttcacgctgcggctgccggagcacgtgcgcagggagatggtcgccgcgggcgagcagagcatgcgactgcgtcgcgggcgaagagccggggaaggaagcagccgaggcggccgaagcgcccccctcggccgggcgagcagatggcagtcgcttctcgcggggaccttctccgggaagctgtccttcttttcggcgtccaggataacggtcagctcggccgagctgggagaggtgtcgtcctcgtcgtccacgagggcgagagggaagcgcgtggccgccgttgatgccgccgacgctcttgctagtgctaagggcagcgtccgccttgaccgcatcggaggcggcggcgtgtccggcgctgcgtcccgctcccgcgaggtggcggcagcggcggacgaggagaagtcagctacgcaacaggttcgcacg

SEQ ID NO: 5536 - DNA, 279 bp, Zea mays
atggccgcgccggcgggggcgagcacgtaccgcgtggcgccgccgtacccgtacgggtacgtggcggcgtaccagcagcagcccccgccccccgccagctactacccgtacccgtcgtactacggcaatggcgacggcgtgggcctcgccaaccccgcccaccactacccgcagccgcagctggcgtacccgccgtacccgtaccgcttcgacgtggcgccgccgccgccgccgccgcagctcttcagcgacgagaaccccaacgcctgctccgtgatg

SEQ ID NO: 5537 - DNA, 123 bp, Zea mays
atgagcgcgccttgtatgttcctgatggcggggaaagtggactgcaggaagcttccgttgtatgtctccaagaaaggctcattcccgactgcaacatacctgatgctgacgccgtcgttgagg

SEQ ID NO: 5538 - DNA, 693 bp, Zea mays
atggcgagcagcgcggggaaccgcttcctgaggcagctgagcgcgagcaacggcgacgaagcggtctgcggcggcctgcagatggaccagcaggagtacggcggcgccggcgtggggaggaggggatcccggcggtggtcgaagaagcgggccgccgccgccgccgccgcgaggggctacggcgccggcagcgggaatggcgtgaagcagccggcctctgccgcggggaagcgggtgatggtggtggtggacgagagctcgggagccaaccacgccatgatgtgggcgctcacccacgtcgccgacaagggggacttcctcacgctgctccacgtcctgccgcgctccggcagcggcaggggcgaggaggcctcctccctcgccaactcgctcggcacgctctgcaaggcctccaggccagaggtggaggtcgaagcgcttgtgatccaagggcccaagctgggcaccgtgctcagccaggtgaagaagctggaggcctccgtgctggtgctcagccagtgcaggccatctccctgctggttaagctgcttcctgcggagcagcggcgaggagtttgtggagcagtgcatcaaccaggcggagtgcctgacgctggcggtgaggaagcagagcaagggcgtcggtgggtacctcatcagcacccggtggcagaagaacttctggctcctggcc

SEQ ID NO: 5539 - DNA, 465 bp, Zea mays
atgcagatcttcgtgaagaccctgacggggaagaccatcacgctggaggtggagtcctcggacaccatcgacaacgtgaaggccaagatccaggacaaggagggcatcccgccggaccagcagcgcctcatcttcgccggcaaacagctcgaggatggccgcaccctcgccgactacaacatccagaaggagtcgacgctgcacctggtgctccgcctcaggggaggcgccaagaagcgcaagaagaagacgtacaccaagcccaagaagatcaagcacaagcacaagaaggtgaagctggccgtgctccagttctacaaggttgacgacgccaccggcaaggtcacccgcctccgcaaggagtgccccaacgccgagtgcggcgcgggggtcttcatggccaaccacttcgaccgccactactgcggtaagtgtggcctcacctacgtctacaaccagcaggcg

SEQ ID NO: 5540 - DNA, 384 bp, Zea mays
atggtggttaatctgaaactaagagaagatgttatagtagagaagtgccttggcagaaggatttgcggccaatgtggaaagaacttcaatttggcctgcattgatgttaagggtgaaaatggactcccaccaatctacatggcaccactgttgcccccaaacaactgcatgtcgaagcttattacccgagctgatgataccgaagaggtggtcagaaatcggcttcagatatataatgacatgagtcaacctgtggaaggtttctaccgagagcaggggaagctcttggaatttgacttgcctggtgggatccctgaatcttggccaaagctgctccaggttctaaacctcgaggaccaagaggagttgaggttggctgcagcg

SEQ ID NO: 5541 - DNA, 495 bp, Zea mays
atgtcgtcggtgttcagcggcgatgagacggcccccttcttcggcttcctcggcgccgccgccgccctcgtcttctcatgcatgggcgccgcgtacgggaccgcgaagagcggcgtcggcgtggcgtcgatgggtgtgatgcggccggagctcgtcatgaagtccatcgtgcccgtggtcatggctggtgtgctcggtatctacgggctcatcatcgccgtcatcatcagcacggggatcaaccccaaggccaagccctactacctctttgatggctacgcccacctttcgtccgggcttgcctgtggtctcgctgggcttgcagctggcatggccatcggcattgtcggtgatgctggagtcagggcaaatgcgcaacagccaaagcttttcgttggcatgatcctcatcctcattttcgcagaagcgcttgctctctatggtctaattgttggaattatcctttcgtctcgcgctggtcaatcccgggcggat

SEQ ID NO: 5542 - DNA, 534 bp, Zea mays
atgctcatttccgaacaattcaatgtctcgttacaagcaagcatgctcacacataggcactcaacttgcgtagagagttgggcgcagagaatccccaagcaaacaaacagggtagagggagaggagaggagaggagaggagaggttgggtctgggacaccatggctccgatgaagctgtacggggcggtgatgtcgtggaacgtgacgaggtgcgcaacggcgctggaggaggctggctccgactactagatcgtgcccatcaacttcgtcaccgtcgagcacaagagccccgagcacctcctccgcaacccgtttggccaggttccagatctgcaggatggcgacttgaacctcttccaatcccgagctatcgtgccgcccgcttgctctctgtaaccaccaaatacctgctgagggaacgtaacactcaacgaggctacaaaggtctgagtcattgttatcccttgtttctccccacctcactgatcttaagacggtcactccgttactggttaaccacatcgagtatacaa

SEQ ID NO: 5543 - DNA, 1350 bp, Zea mays
atgaaagtcccggtgcttctcctcctggtctccctgtgcttctcgctcgcgctcgcgtggcaaacggacacggaatcgggctcaggcaggccgtaccactacggcgaggagagtttccggcactggacgcgctcccggcagggccggttcagggtgctggaacggttcacccacgagctgctggaggacgccgtcggcaactaccgcgtcgccgagctggaggccgcgccgcgcgcgttcctgcagcccagccactacgatgccgacgaggtgatgttcgtgaaggaaggcgagggcgtcatcgtgctgctccgcggcgggaagagggagtcgttctgcgtcagggagggcgacgtcatggtcatccccgcgggcgccgtcgtgtactcggccaacacgcaccagtcggagtggttccgcgtcgtcatgctcctcagccccgtcgtctccacgtctggacgcttcgaggagttcttccccatcggaggcgagagccccgagtccttcctcagcgtcttcagcgacgacgttatccaggcgtcgttcaacactcgccgggaggagtgggagaaagtgttcgagaagcagagcaagggggagatcacgacggcgtccgaggaacagatccgggagctgagcaggtcctgctcacgtggtggccgcagcagccgcagcgagggtggcgactcgggttcttcttcttccaagtgggagatcaagccgtccagcctcacggacaagaagccgacccattccaacagccacggcaggcactacgagatcaccggcgacgagtgcccgcacctccggctgctcgacatggacgtcggcctggcaaacatcgcccgcggttctatgatggcgccgagctacaacacccgcgccaacaagatagctatcgtcctcaagggccagggctacttcgagatggcgtgcccgcacgtctccggcggccggtcgtcgccgcgccgggagcgtgggcacggccgagaggaagaggaggagcgggaagaggagcaaggcggtggcggtgggcaaaagtcgaggagctacaggcaggtgaaatcccgcatcagagagggctccgtcatcgtgatcccggcggggcacccgaccgcgctggtcgccggcgaagacaagaacctcgccgtcctctgcttcgaagtgaacgccagcttcgacgataaggtgttcctcgcgggcacgaacagcgcgcttcagaagatggataggccggcgaagctgctggcgttcggggcggacgaggagcagcaggtggaccgtgtcataggagcacagaaggacgccgtcttcctgcgcgggccccagagccacagggtctcgtcggtg

SEQ ID NO: 5544 - DNA, 474 bp, Zea mays
atggacaacatggacaacgacaccaagctgctgcatgacaggtactatgcccgaggtgacgatgtcatgctcccggaggttccatatgatcagttccgggctgggtcgcagttctttgtgctcacgagaaggcacgccatcatggtcgtgagggatatgcgactttggaagaagttcaagttgccctgtctgatcgagcgcagggattcatgctacccggaggagcattacttccccacactgctggatatgcaggatcctgagggttgtactaagtatacccttacaagggtaaattggacggattcagttgcaggccacccacacatgtatgagcctggagaggtatccgcaagcttgatcagggagctgaggaagtcgaacacgacacacccttacatgttcgcccgcaagttttctcctgagtgccttgagccgctgatggagattgtggactcggttatcctacgtgac

SEQ ID NO: 5545 - DNA, 720 bp, Zea mays
atggggaggggccgggtcgagctcaagcggatcgagaacaagatcaaccgccaggtcaccttcgccaagcgccgcaacggcctgctcaagaaggcgtacgagctctcggtgctctgcgacgccgaggtcgcgctcatcatcttctccaaccgcggcaagctctacgagttctccagcacgcagagcatgccaaaaacacttgaaaagtaccaaaaatgcagttttgcagggcctgaaacagcactccagaatagagagaatgagcaactgaaaagtagccgcaatgagtacctcaaactgaaggcacgtgttgataatttacagcggactcaaaggaacttgcttggtgaagatcttgagtcattaggcataaaagagctggagcacctggagaagcagctcgattcgtccttgaagcacataagatctacaaggacacaacacatggttgatcaactgacagaacttcagaaaaaagaacaaatgttttgtgaagcaaataagtgtcttcgaagaagactggaggagagcaaccaggttatatggcagcatgcgtgggagcaaagcgagcggcattctgaagtgcagccgcagcagctcaatggcaataacttcttccatcccctcgatggtgctggtgaacccacccttcagatagggtatccttcagaggcactgactagctcatgcatgaccaccttcctgcccccgtggttgcca

SEQ ID NO: 5546 - DNA, 1143 bp, Zea mays
atggacctagagcccggcaccatggactccgtgcgctccggtccctacggccacatcttccgccccgacaacttcgtcttcggtcagtccggggccgggaacaactgggccaagggccactacaccgagggagccgagctcatcgactccgtgctcgacgtggtgcgaaaggaggccgagaactgcgactgcctgcaaggcttccaggtctgccactctctcggcggcggcaccggctccggcatgggcacgctgctcatctccaagatccgcgaggagtaccccgaccgtatgatgctcaccttctccgtgttcccgtcgcccaaggtctccgacaccgtggtggagccctacaacgcgacgctgtccgtccaccaactggtggagaacgccgacgagtgcatggtgctcgacaacgaggcgctctacgacatctgcttccgcacgctcaagctcaccacacccagcttcggcgacctcaaccacctcatctccgccaccatgagcggcgtcacctgctgcctccgcttcccggggcagctcaactcggacctccgcaagctggccgtcaacctgatcccgttcccgcgcctgcacttcttcatggtggggttcgcgccgctcacctccaggggctcccagcagtaccgcgccctgacggtgccggagcttacccagcagatgtgggacgccaagaacatgatgtgcgccgcggacccgcgccacggccggtacctgacggcgtccgccatgttccgcggcaagatgagcaccaaggaggtggacgagcagatgctgaacgtgcagaacaagaactcctcctacttcgtggagtggatccccaacaacgtcaagtcgacggtgtgcgacatcccgcccacggggctgaagatggcgtccaccttcatcggcaactccacctccatccaggagatgttccggcgcgtgagcgagcagttcaccgccatgttccgcaggaaggccttcttgcactggtacacgggggagggcatggacgagatggagttcaccgaggccgagagcaacatgaacgacctcgtgtccgagtaccagcagtaccaggacgccaccgccgacgaggagggcgagtacgaggacgaggaggagggagatctccaggac

SEQ ID NO: 5547 - DNA, 1041 bp, Zea mays
atggacaccggcagcgaccttgtctggacgcagtgcacgccgtgccccgtctgcttcgaccagccgttcccactgttcgacccttccgtgtccagcaccttcagggccgtcgcctgccccgaccccatctgccggccgagctccggcttgagcgtttccgcgtgtgccctgaaaactttccggtgcttctacctctgctcttacggcgacaagtccataacggcgggttacatcttcaaggacactttcaccttcatgtcgcccaacggcgagggcgcgccgccggtcgccgtgtcggggctcgccttcggctgcggcgactacaacaccggcgtgtttgcttcgaacgagtccggcatcgctggcttcggccgcgggcccctgtcgttgccgtcgcagctcagggtcggcaggttctcgtactgcctcacatcgcacgacgagaccgagagcaacaagaccagcgcggtgttcctgggcacgccgccgaatggtctccgagcgcacagctcggggccgttccgatccactccgatcatacacagcccttcgttccctaccttctactacctctctctcgagggcatcaccgtcggcaagacgcggctgccggtcgactcgtcggtgttcgcgctcaagaaggacgggtcgggtgggacggtgatcgactccggcacgggcgtcaccacctttccggcggccgtgtttgagcaactcaagaacgagttcgtggcgcagcttccgctgccccgctacgacaacacctcagaggtcggcaacttgttgtgcttccagcggccgaaaggtgggaagcaggtgcccgtgccgaagctgatcttccacctggcgagcgcggacatggatttgccccgggagaactacatcccggaggacacggacagcggggtgatgtgcctgatgatcaacggcgcggaggtcgacatggtgctcataggcaacttccagcagcagaacatgcacatcgtctacgacgtggagaacagcaagctgctcttcgcatctgcgcagtgcgacaagatg

SEQ ID NO: 5548 - DNA, 408 bp, Zea mays
atggctcgcttctgggcagcctacgtcgacgacaagttctacaaggagtggaaccggctgttctggtcgacgacggcggagaaggcggcggaggcgctcggcgtcgtcgtccccgtggtggagacgctggagcaggcgttcagggagtgctccaaagggaaacccttcttcggcggcgacgccgtcgggctcgtggacatcgcgctcgggagcttcgtggtgtggatcagggtggtggacgaggcggccggcgtaaagcttctggacgaggccaagttcccggccttgacggcgtgggcggagcgcttcttggcggtggacgccgtgaaggaggtgatgccggacgccggaaggctgttggagcactacaaggggtttctggctaaacggtctccacctgctggttac

SEQ ID NO: 5549 - DNA, 501 bp, Zea mays
atggagtacggtcagcaggggcagcacggccacggcgccacgggccatgtcgaccagtacggcaacccagtcggcggcgtcgagcacggcaccggcggcatgaggcacggcacgggaaccggcggcatgggccagctgggtgagcacggcggcgctggcatgggtggcgggcagttccagcctgcgagggaggagcacaagaccggcggcatcctgcatcgctccggcagctccagctccagctcgtcggaggacgacggcatgggcggaaggaggaagaagggaatcaaggagaagatcaaggagaagctgcccggaggccacaaggacgaccagcacgccacggcgacgaccggcggcgcctacgggcagcagggacacaccggcagcgcctacgggcagcagggacacaccggcggcgcctacgccaccggcaccgagggcaccggcgagaagaaaggcattatggacaagatcaaagagaagctgcccggacagcac

SEQ ID NO: 5550 - DNA, 687 bp, Zea mays
atggcggtttctttcgcaaacctcaactccgaggcagggcttaaaaagcttgatgagtaccttctcactcgcagctacatcactggctaccaagcttccaaggatgacttggctgtctacacttcgttttcggctgctccctcgtccaagtatatcaacgtagcaaggtggtttaaccacattgatgcgctcgtgaggctgagcggaattactgcagagggccaaggtgtgaaggttgaatcctcagcagttccttcagccccaactccagatgttgctgaagcacaggccccagttgctgaggaggacgacgacgatgatgttgacctttttggtgaggagaccgaagatgagaagaaggctgctgaagagcgtgctgcagctgccaaggcttctggcaagaagaaagaatctgggaagtcatcagttttacttgatgtgaagccatgggacgatgagactgacatggccaagctcgaggaagctgttaggagtgtccagatggaagggctgctctggggcgcatccaagcttgtcccagttggatatggtatcaagaagctgcaaatcatgatgaccatcgtcgacgaccttgtctctgtcgacactctcattgaggactatctgtgcgctgagccagtgaacgagtacgtgcagagctgcgacatagttgccttcaacaagatc

SEQ ID NO: 5551 - DNA, 786 bp, Zea mays
atggccatggcggccgtgggcgtgggcggcgcagtggcgttcctcctcccgcagcgccgccagggcgccgtcccctggagcggcgggcggcggcgggcgcccgtggcggtgcgcgcgtcgtacgaggccggggtgggcgtgatggcgaccaaggtggggatgatgacctacttcgatccggagacggggaagccggtgccggtgaccgtggtcgggttccgggagggcggcaacgtggtgacgcaggtgaagacggccgccacggacgggtacgacgccgtccaggtcgggtaccacggcgtgcgcgaggacaagctcacccgcccggagctgggccacctgggcaaggccggcgccccgccgctgcgccacctgcaggagttccggctcaccgccgtcgacgccttcgagcccggccagcccctcgacttcgccgacctcttcaaggagggcgacctcatcgacgtctccggcaactccatcggcaaggggttccaaggtggcatcaagaggcacaacttcaagcgcgggctgatgacgcacggttccaagagccaccggcagctgggttccatcggagccgggacgacgccgggccgcgtgtacaaggggaagaagatgcccgggaggatgggaggaaccaagaccaagatcaggaagctcaagatcgtcaagatcgacaacaacctccgggtgctcatgatcaagggggccgtgccagggaagcccgggaacctcctccgcataacgccggccaagatcgtcggcaagaacatccccaagaac

SEQ ID NO: 5552 - DNA, 729 bp, Zea mays
atggacggcgaggacctcagggacttcgccgccggcagcagatacgagcccacagctgccgccgttttctcgcaggtcgtcgatctcggttccgaagtcgcgtcaccgcgccaatgcgtgttggccgctctacagaagctgtccgtcgaccacggagtgcccccggcttcagatgcctgggtcgcgaagcacatcgtggagccggcgttgcagcagcttcttcctgccgatcagcctgggcagcagccggcctcccgcgatgacctgttccagcagctgaagaagctgctgggcgccgtcgctgatcgactccaggagcagcctgtgatcgtcgcgcacaccgagaaccactatgacgggagtggcgtcaagaggctgctggccaacaaattcgagttggacaagctgctggattctgtctggaaaaatttggcagcagaagataagaacaaggcgtccaaggggtgcctcataaccgcgcttgacaagatggccgatgctgcaagccttccatattacagtgctgtgaaagaggtggatgctgtcgtggaagagtcgatcaagacagcgggcgtcgaagaaggaaaggcagtggatgaagcggagttcaagaagtcgctcacagaaatccttagggctatcatgctgaggctgaacgacagccccgtcttcgtctctaccgacgtcgtcgtgcacgagcctttgtccgggacatcatcgtcggtgaac

SEQ ID NO: 5553 - DNA, 789 bp, Zea mays
atgagggtggtggagcgcgtgcagaagaagaccggccgcaaggtggagttgctgtcgccgatcccgccgccaacgccgccggaggagaagaaggcagaggaggagcccgagccgccaaagccggaggagaagaaggagccgccggtgatcgccgtggtgctgaaggtgcacatgcactgcgaggcctgcgcccaggggatcaggaagaggatcctcaagatgaaaggcgtgcaatctgcagagccagacctcaaggcgtcggaggtggcagtgaagggcgtgttcgaggagtccaagctggcggagtacgtgtacaagcgcaccggcaagcacgcggccgtcgtcaagtccgagccggtcccggcgccaccgccggagagcggcgccggcgacaacacgggggccaaggaggaggagaaggggcaggaggaggagaaggagaaggaaggaggaggcgatggcggtggcgaggagaagaagaaggaagggggcaaggaggaagagaagaaggacggcgagaagcaggaggaggagaaggagggcggcggtggcggcgagaaggtggaggaaaaggagggagataaagacgctgccgctgccgccgccgccagcatgtacatgcactacccgaggttcccgttcccgggaggctactacgcgccgcctccggggtacgtctaccagccggtgtacccggcgccggcgtacgcggcgtacgcgccgccgcaccaccagcccatggcgccgcagatcttcagcgacgagaaccccaacgcatgctccgtcatg

SEQ ID NO: 5554 - DNA, 1440 bp, Zea mays
atgcgtgtaatggtttctactgtgatgcattttctcctaacaaaccttacaagcccacaatgtggactgaagcttggagtggctggttcacagaatttggtgggaccatccgccaacgaccggttgaagatctcgcatttgctgttgctcgatttgtacaaaagggtggctcttttatcaattactacatgtatcatggaggaacaaattttggacgcactgctggggggtcccttcatcacaacaagctatgattatgatgctccaattgatgaatatggacttattagagaaccaaagcacagtcatcttaaagaactccacagagctgttaagttatgtgaacaggctttggtttctgttgaccccacaattactacccttggaactatgcaagaggcccatgtcttccgatctccatctggttgtgcagctttccttgcaaactacaattctaactcccatgcaaaagttgtgttcaacaatgagcaatacagcctcccaccttggtcaattagcatccttcctgattgcaagaatgtagtttttaacagtgccacagttggtgttcagacatctcagatgcaaatgtggggagatggtgccacatcgatgatgtgggagaggtacgatgaggaggttgattctctggcagctgctccattgctcaccacaactggtttgcttgagcagcttaacgtcaccagagacagcagtgattatctgtggtacattaccagtgttgacataagcccatctgaaaactttctacaaggtggtggcaagcctccgtctctgagtgttcagtctgctggtcacgccttgcatgtctttgtcaacggacaacttcaaggttcttcgtatggtaccagggaggatcgaagaattaaatataatggcaatgttaaccttcgagctggtactaacaaaatcgcactactgagtgttgcttgcggattgccgaatgttggagtgcattatgagacgtggaacaccggcgtcggtggtcctgtcgtgcttcatggattgaatgaaggttcgcgagaccttacttggcagacctggtcctatcaggttggcctgaaaggcgagcagatgaatctgaactccgtagaaggctcaggctcagttgaatggatgcaagggtcactgatagctcagaagcaacagccgttggcctggtataaggcttacttcgagactcccagcggggacgagccattggctttggatatgggcagcatgggcaagggacaggtctggataaacggacaaagcattggacgctactggacagcgtatgcagacggggactgcaaagggtgcagctacaccggggacttcccgggcacccaagtgccaagcaggctgcggccaaccccacccagcgttggtaccatgtgccaaggtcctggctgcagcccagcagaaacctactgg

SEQ ID NO: 5555 - DNA, 426 bp, Zea mays
atggcccgcctcggcgccggcgccgtgttggcgctcctagtggcggtcgcggcggtggccgcgttcctcgcggtgccggcctcggcgaagtccggggagctgagcgcgatggggttgctggcggcgaagggcggcagcggcgcgggcccgcagaagtgctcgggcgcggtgggcgagtgcgacgtggacgaggcggaggagctcgggctgagcggcggcggcctcggctccgacgacgcggtgcggcggacgctggcgcagcggaagccgaccaaccggtacatcagctacgcggcgctgcgcgcggaccaggtgccgtgcaacaagcgcggccggtcctactacagcaactgcgaggcgcagaaggccgccaacccctaccgccgcggctgctccgccatcacgcgctgcgcccgcaacatgaac

SEQ ID NO: 5556 - DNA, 1173 bp, Zea mays
atgcgccgctgccttgtcgaccgcttcggcttcgacgaggccgacatccgggtcctcaccgacgccgaccgatccgcgccgcagcccacgggggctaacatccgccgcgccctcgcccgcctcgtcggggatgcccgccccggggacttcctcttcttccactacagcggccacggcacgcgcctgccagccgagacggggcagcacgacgacaccggctacgacgagtgcatcgtgccctgcgacatgaacctcatcacagatcaggatttcagggaactcgtgcagaaggtccctgaaggttgcctattcaccatcgtctctgactcatgccatagtggtggcctgctggacagtgctaaggagcagataggtaatagcaccaagcagaataagacccagtcccgtgaacctgatgagcctcgtcattctggttctggcagcggcttccggtcatttctcaaagagactgtccgcgatgtgttcgagtctgaggggattcacatccctcatagtcgtcgccatggggatgatgaccaggacgacggttacgcacagccaactggaaatggccgcaccaaaaaccgctccctgccactctcgaccctgatagagatgctcaaggaacaaactggaaaggatgacattgatgtgggttctatccggatgacgctgttcaacatctttggtgatgatgccagcccaaagattaagaagttcatgaaggtcatgctcggaaagttccaccagggccagtcaggtgagcaaggcagtggtggtggtggtgtctttggcatggttggtgcccttgctcaggagttcttgaaggctaagcttgaagggaaggaggaagaggctttcaaacctgcattagagcaagaggttcacagtgttgacgaggtgtacgccgggagtaaggcctgggcaccaaacaatggcattctgatcagtgggtgccagactaaccaaacatcagcggatgcaactacaccgcagggtgtctcctttggtgctctgagcaatgctatccaaaccattcttgcagacaagcacgggaaggtgacgaataaggatctcgtgatgaaagcacgtgagctgctgtccaagcaagggtacactcaacagcctggactatactgcagcgatgagcatgttcatgtcgctttcatatgc

SEQ ID NO: 5557 - DNA, 1350 bp, Zea mays
atgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcaccttcttcagccagactggtgctgggaagcacgttccccgtgcaatcttcgttgatctagaacccactgtgatcgatgaggtgcgcactggcacgtaccgccagctcttccaccctgagcagctcatcagtggcaaggaggatgccgctaacaatttcgcccgtggccactacacaattggcaaggagattgttgatctgtgccttgaccgtatccgcaagcttgctgacaactgcaccggcctccagggcttcctggtcttcaatgccgttggtggtggcactggctctggccttggttctctcctccttgagcgcctgtctgtggagtacggcaagaaatccaagctgggcttcactgtgtacccatctccccaggtgtcaacctctgttgtggagccttacaacagcgtgctctccactcactcactcctggagcacactgatgtctccatcctgctcgacaacgaggccatctatgacatctgcaggcgctccctcgacattgagaggcccaactactccaacttgaatcgccttgtgtctcaggtgatctcatcgctgactgcttctctgaggttcgatggtgccctcaatgtggatgtgaacgagttccagaccaacctggttccttacccgaggatccacttcatgctctcctcctacgcaccggtgatctcttctgcgaaggccttccacgagcagctgtctgtggcggagatcaccagcagcgcgttcgagccggcttccatgatggtcaagtgcgacccacggcacggcaagtacatggcttgctgcctgatgtaccgcggcgacgtggtgcccaaggacgtgaacgccgcggtggccaccatcaagacgaagcgcaccatccagttcgtggactggtgcccgacggggttcaagtgcggcatcaactaccaggcgccgacagtggtgccgggtgccgacctcgccaaggtgcagcgcgcggtgtgcatgatctccaactccaccagcgtcgtcgaggtgttctcccgcatcaacagcaagttcgacctcatgtacgccaagcgcgcgttcgtgcactggtacgtcggcgagggcatggaggagggggagttctccgaggcacgcgaggacctggccgccctggagaaggactacgaggaggtcgccgcagagggcggcagtgatgacggtgacgaggaggaggaatac

SEQ ID NO: 5558 - DNA, 423 bp, Zea mays
atgagccggggtagcctgcaggaggatatccaccttgaggtgggtagccacctggctgagggtacccatattgtggtgggtatgccccaggtggaggaggatatgcccctggaggaggaggatacgcccctgggggaggcgggtatgctcctggttgcggtgggtagccctgcggagggtatccctggtgggggtacccatgaccaccggcaacgccgtgcatcatgttcgagaagagccccttgtcgctctcgtcatgcttgtctttccctcctcccattgaccccgcaagttaccgaacgacgacgcgaactccggcgccctgaagcagcacagatgtgcagccgatctcggccggcgatgttccctgtcggcggcgggtgctggtttggccgttccccttccccccggctggcggatata

SEQ ID NO: 5559 - DNA, 717 bp, Zea mays
atgaaaacaaacgaggttttgtctgaggagatacaagagcgcgatgaagccgctttgaaatatctaaaagatatcaagtggtctagaatcgaggatcctaagggtttcaagctggattttttctttgatacaaacccattcttcaagaattctgtcctgacaaaaacgtaccacatggttgatgaagatgacccaattttggagaaagctattggaactgaaatcgagtggtatcctgggaaaaacctaacacagaagattctaaaaaagaaacctaaaaaaggttcaaagaatacgaagcctatcactaaaaccgaggactgtgagagtttcttcaactttttcaatcccccgcaggtccctgaagatgatgatgacatcgatgaagacactgctgatgagctgcagagtcaaatggagcatgattatgacattgggaccaccataagggataagattatccctcacgcagtttcctggtttactggtgaggctgtgcaaggtgaggattttggtgagttgggcgatgatgatgaagatgatgatgatgaagacgatgacgaagatgatgaggatgaagaagaggatgatgatgaggaagaggatgatgaggaagaaagcaagccagcaaggaagtcaggatctggtcgcagacataaggcgccacagaaggtgtcgcagggaaatgcggaacaaccagcggagtgcaagcagcag

SEQ ID NO: 5560 - DNA, 1035 bp, Zea mays
atgtgggagtgccccgacttctacccggtgagcaagggcggcgcgccgcgcgcggggctcgagacgtccgtgccgcccggcccaagggtgaagcacgtgctcaagaacagcctcgacctccggcggtacgactactacaccgtgggcacgtaccacccgagggccgagcggtacgtgccggacgaccccgccggcgacgagcaccgcctgcgctacgactacggcaacttctacgcgtccaagacgttctacgacccggccaagcggcgccgcatcctgtggggctgggctaacgagtccgactccgccgccgacgatgtggccaaaggctgggctggaatccaggcgattccaaggacggtgtggctggaccccagcgggaagcagctgctgcagtggcctatcgaggaggtggaggcgctgagagaaaagtcggtcactctcaagaacaggttaatcaaggcaggacatcacgtcgaggtgaccgggatacaaacggcacaggctgacgtggaggtgagcttcgaggtgtcgccggcggccctggccggtgccgagacgctggacccggcgctggcctacgacgcggagaagctgtgcggcgtgaagcgcgcggacgtgaggggcggcgtggggccgttcgggctgtgggtgctggcctccgccaaccgcaaggagagaaccgccgtgttcttcagggtgttcaagcccgccgccggcagcgacaagcccgtggtgctcatgtgcaccgaccctaccaagtcgtccctgaacccgaacctgtaccgcccgacatttgcaggatttgtcgacacggacatctcgaacggcaagatatccctgagaagcctgatcgaccggtcggtcgttgagagcttcggagccgggggcaagacctgcatcctctccagggtctacccgtcgctggccatcggcaaggacgctcgcctctacgtgttcaacaacgggagggcgcacgtcaaggtgtcccgtctcaccgcgtgggagatgaagaagccggtcatgaacggggcc

SEQ ID NO: 5561 - DNA, 597 bp, Zea mays
atggtgatgaagcccatgggcatgcccccggccgctgctgccggtggcggcaacggaaacggcggcggcaagaagggtggcggcgggaacgaggtcccggttcagatcaatgggaacgccagcaacggcggcggggcgaagcagaacgggggcggcaaaagcggggccaagaacggcaagggcggcggcggcggcggcggcgtcgttgccccgggcggcgggaaccaggctgggcagggcaagccgaaaggcggcttccccggcggcgccggtctcggcgggccgatgatgggcggcgcgccgccgccgcatgcgggcatgatgatgaggccgccgaacatgatgggcggcgcgggcggttttccccggcatgggccagatgggcggccacccccacatggggtggcggcggcatgccgcaggcaggcgggggcgccgcgcacggcatgccggctggtggcagcatcagcatggccgctggcggaatgcctggggccgggttctttccgcgcggcgttggcggcggcatgccggccggcgcggagatgctgggcatgtcgcagctgcctccgcagcagcagcagcacatggcggcgg

SEQ ID NO: 5562 - DNA, 123 bp, Zea mays
atgccgtcgcactcgtcgcgctcctccgacatgtcgggcagcgggtcccaggcgtcggccccggcgtcgtacgcctcggcggtcttgagcgcgttcttgtgcttgtcgtggccgcccgccacg

SEQ ID NO: 5563 - DNA, 636 bp, Zea mays
atgtatgatttcatggccctcgatagaccttcaactcctaccattgatcgtgggatagcattacataagatgattagacttatcacaatgggtttaggaggagagggctatcttaatttcatgggaaatgagtttggacatcctgaatggatagattttccaagaggtccgcaaagacttccaagtggtaagtttattccagggaataacaacagttatgacaaatgtcgtcgaagatttgacctgggtgatgcagactatcttaggtatcatggtatgcaagagtttgatcaggcaatgcaacatcttgagcaaaaatatgaattcatgacatctgatcaccagtatatttcccggaaacatgaggaggataaggtgattgtgttcgaaaagggagatttggtatttgtgttcaacttccactgcaacaacagctattttgactaccgtattggttgtcgaaagcctggggtgtataaggtggtcttggactccgacgctggactatttggtggatttagcaggatccatcacgcagccgagcacttcaccgccgactgttcgcatgataataggccatattcattctcggtttatacaccaagcagaacatgtgtcgtctatgctccagtggag

SEQ ID NO: 5564 - DNA, 378 bp, Zea mays
atggtgcgcaacgcgaagaaagccgaggcggagatcgcccctctgaagatatcctccctcaagaagatcggaaagggctccaacgtcatcatcatggactcgtacagcgacgtcgccaagactgtggcgaagacgctggacagcgtggggttcaagaactgctgggtcatggccggcggcttttttggccggaaagggtgggcgcagagccgtctcggaacggattcctacaacctatccgtggtcgaagtcgtcacgccgtcacgtgtgatccctgctgtcgcaggcccccccactgggacgaccgctgcacccattgggacggcctcgtcggcgtccagagcgactactcgcaagctttttcccggcggcgtagac

SEQ ID NO: 5565 - DNA, 654 bp, Zea mays
atggtgctgtgggtcttcggctacggctccctcatctggaaccccggcttcgacttcgacgacaaaatcctcggcttcatcaagggctacaagcgcacctttaatctcgcttgcattgaccacagaggcacaccggagcatccggcgaggacctgcacgcttgaaaccgacgacgaggccatatgctggggaattgcatattgtgtcaagggtggtccagaaaaagagctaaaagcaatacagtacttggagagaagagagtgtgagtacgaccagaaaatatccattgatttctacaaggaaggagatcccttgaaaccagctgtgacgggcgtcttagtgttcgtttccactccagatccaattggcaacaagtactatcttggccctgctcctctgcaggatatggcaaggcaaattgctacagccaatggccctactggctataatagggattacctgttctcaatggagaaggcattagccagcattagccacgaagatgattcgatcatagagcttgcaaacgaggtgaggaaggtgctcaacagaacaaaggagaccaagatcactggtgccaatgcttccatgaaatcacatgcccctcttgtgcacctgtccgcgcttccagaaggcaccgttgtggactcgaga

SEQ ID NO: 5566 - DNA, 450 bp, Zea mays
atggcgcccaaggcggagaaaaagccggcggcgaagaagcccgcggaggaggagcccgcgaccgagaaggcggagaaggctccggcagggaagaagccgaaggcggagaaacgcctccccgcgggcaagtccggcgccggcgagggcaagaagggcaagaagaaagccaagaagagcgtggagacctacaagatctacatcttcaaggtgctcaagcaggtgcaccccgacatcggcatctcgtccaaggccatgtccatcatgaattccttcatcaacgacatcttcgagaagctcgccgcggaggccgccaagctcgcccgctacaacaagaagcccaccatcacctcccgcgagatccagacctccgtccgcctcgtcctacccggcgagctcgccaagcacgccgtctctgaaggcacaaaggcggtcaccaagttcacttcgtct

SEQ ID NO: 5567 - DNA, 1338 bp, Zea mays
atggcggtcacgatcacgtgggtgaaggcgaggcagatcttcgacagccgcggcaaccccaccgtcgaggtggacgtgggccttagcgacggcagctacgcgaggggggccgtacccagcggcgcatccactgggatatatgaggccttggagttgagggatggaggatctgattatcttggcaagggtgttcttaaggctgtcagcaatgtaaataacattattggaccagcaattgttggaaaggaccccactgagcaggttgagattgacaacttcatggtccaacagcttgatgggacctccaatgagtggggctggtgcaaacagaagcttggagcaaatgccatccttgcggtttcacttgcggtgtgcaaagctggagctatggtgaagaagattcctctttaccagcacatcgcaaatcttgctggaaacaaaactctggtgctccctgtacctgcctttaacgtgattaatggagggtcacatgctggaaacaagcttgccatgcaggagttcatgatcctcccaactggtgcctcctcgttcaaggaggccatgaagatgggagttgaggtgtaccacaacctgaagagcatcatcaagaagaagtacggtcaggatgcgacaaatgttggggatgaaggtggttttgcacctaacattcaggaaaacaaagaaggccttgaactattgaaggcagccatagaaaaggctggctacactggaaaggtggtcattggaatggatgttgctgcttctgagttcttcggtgagaaagacaagacttatgatcttaatttcaaggaggagaacaacgatggctcaaagaaaatttcaggcgacagcctgaaagacctgtacaagtcctttgtttctgagtaccctatcgagtcgatcgaagacccatttgatcaggacgactggagcacttatgccaaactcactgatgagattggacagaaagtgcagattgtaggagatgatcttctcgttaccaaccccaccagggtcgccaaggccatcaatgagaagacctgcaatgctctcctcttgaaggtgaaccaaatcgggtctgtgaccgagagtatcgaagctgtcaggatgtccaagcgcgccggatggggagtgatggcaagccacaggagtggcgagacagaggacaccttcattgctgacctctcagttggcctgtctacgggccaaatcaagacgggagctccttgccggtctgagcgcctggccaaatacaaccagctgctcaggatcgaggaagagctcggtgatgccgcggtctacgccggagcaaagttcagggcaccagtggagccctac

SEQ ID NO: 5568 - DNA, 549 bp, Zea mays
atgacgtgcagcggccacatgctctgctgcaccgccacgctgaccaggaccttgctcggcgtcctccgccccgcgtcgccgtccgggggcggggacccggagcggaagctcgccccccggacgccggcgagcaggtcgggcagcgtcttgggcctctgcttctgcggctggtggtgccgctgctccgtcccgcgcccgtggaacgacgccgaccgctgggccggggccggggccgccgccgccccctgccgctgcctgccgcccttctcaccgtgcggcggcgccagaggaggcatcgcgagcgccggctggctgcagaggcgggggggctctagacgtcgcggcgatccggccgctggcggtgacggtggacgagagccacgtactcacgttcggtggcggccggacgacgaggcggtcaatgcgaagcggagcatgctgcggggagaggaggctgctgctgctgctgcagtcaccatgcgcgcaggagggtggaggtggagccttgtgatgagttccgcgaggatgcaccaggaccagagaggctac

SEQ ID NO: 5569 - DNA, 768 bp, Zea mays
atggcccactcgaggcggttgagcagctcggtggagttcttgttgtacatgaagaggccgttgtacaggtcgaagctgtcgctgcaggtgttgtccacgaggcggatcagcgtctcgtaccccctggtgtcgacgggcgtggagcgcagctccagcgtggccagcatccgcccgacggtgtgcgtcaggaactgggtctcggcggcgtgcgcgtcgtgctcggcgcaggacatctccaccatccggcacccctcgcgctcgaaggcgccgaggaacgcgtcggcgcgggcgcggcgcgcggggcagtccccgacgcgcacccgctcgaacaccagcggcaggccgtcccacccgtcgcgcgccgactccggcccgaacatggggtgcgtgcagatcacgtcgaagccgggcggcagcgagctcaggagcaggttcctggggaactccttcacggagagcacgtccgcgaagagggtgctgcggcggagccggtgcaggggcagcgaccgcagcacggcctccgcggacaggatggaggtggcgagcagcaccacgtccgggtggcactcgcacaggtcgtgcgggtcggtgaagaaggcggcgcccagcgcggacgccgccgccgagtggtccgtccgcgagtgcgccagcagcgtgtgcccctgccgcgcgaacgtgcgcgccaggaactgcccgaagttgccgaaccccacgatggcgatcttcagccgctgccgctcctccagcggccccgccgcgcgggactcg

SEQ ID NO: 5570 - DNA, 381 bp, Zea mays
atgcgaagctggcgtgcccgctctgccgcaccccggcgcccgacatcaagtccatgcagatccaccacgaggcgcgccaccccaagctccccttcgagccggagaagctcctcaacctgcactcctccgcccccgctgctgccgccgccgccgccgctgccgccgccgctgccgaggccaccacctccaagcccaagcccggcgtccgcggcagcctcaagaagtaagcttgctgggcttggttggctcgcccgcctgcatggggcgcaattcccttcggtttcaatcccatccgccgacccgatctataatcaatcaaaccgccgccctccggcctggcggctgccgcagtcggcctgcggtgtactgttagtctgctgc

SEQ ID NO: 5571 - DNA, 540 bp, Zea mays
atggtaaaatcaacagttgtcgacagcactactggtaaaagcaaggacagcagggtccggacaagttcgggcatgtttcttcaaagaggaagggacaaggttattcgagtaattgaaaagaggattgcagactataccttcatacctgtagatcatggagagggactccaagtactgcattatgaagtcgggcagaagtatgagcctcactttgattattttcttgatgagtttaacaccaagaatggtggtcagaggatggctactcttctgatgtatctatcagatgttgaagaagggggcgagactattttccctgatgcaaatgtgaacgtcagttctttaccatggtacaatgagctttcagagtgtgccaagagaggcctttctgtcaaaccaaagatgggagatgcacttcttttctggagcatgaaaccagatgccaccctggacccattaagtttgcatgggggttgtcctgtgattagaggaaataaatggtcgtcaaccaagtggatgcatatccacgagtacaaagct

SEQ ID NO: 5572 - DNA, 750 bp, Zea mays
atgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtcggtgggcgcgaacatctccggcgggcacgtgaacccggccgtgaccttcggcgccttcgtgggcggcaacatcaccctgttccgagggctcctgtactgggtggcgcagctgctggggtccaccgtggcgtgcttcctgctccgcttctcgacgggcgggcaggccacgggcaccttcgggctgacgggcgtgtcggtgtgggaggcgctggtgctggagatcgtgatgaccttcgggctggtgtacacggtgtacgcgacggcggtggacccgaagaagggcagcctgggcaccatcgcccccattgccatcggcttcatcgtgggggccaacatcctggtgggcggcgccttcgacggcgcgtccatgaaccccgccgtgtccttcggccccgccctcgtcagctgggagtggggctaccagtgggtgtactgggtcggccccctcatcggcggcggcctcgccggcgtcatctacgagctgctcttcatctcccacacccacgagcagctcccctccaccgactac

SEQ ID NO: 5573 - DNA, 399 bp, Zea mays
atgtcgtactacggcgaccggcgcgcggagtcgtcgatcgtggaggcgttcacgctgtcgccgctgccgtacccggtgatcctggtgctgctgatggtgacgctgctgctgggcgcctcgtggttcttcacgtacgacgacttcatcgaggaggcgtcgcagcagctgagctgggcgctgctgggcgtgcccatcgcgctcgtcctcctcatccgctggatctcctccgtcgactccttcgagggctacctgggcttctacccgagggagagccgctggaagggccgctacgagcggggccccgccgagggcagctcgccctggggcgtcgccttgctcgtcctcctcctcctcgtgctcgccagcttccactccaccatccacgacatgtgggggccg

SEQ ID NO: 5574 - DNA, 1122 bp, Zea mays
atggcgatgccaccgaagcccggcgacccgccgcagcgctcgccggcacgtagcccaaacctcaatctcccctgcccgctgccgccggtcccgggcggggcgccgccaccgccgcagcagcagccgggcgccgggctgcccccgccgcgcgtgggccaccaccgccgcgccagatctgaggtggccttccgcttcccggacgacctgcccggcggcgggggcggcggcttcgacgagatcggctccgaggacgacctcttctccaccttcatggacatggacaagatcgccggcgccgaccgcgaccgcgccgccgagacctcctcgccgccgcgcccagccaagcaccgccacagcgtctcctttgacggcttcgggatgggggctgccgccggcggcccgggcggccagcaggacggcggtggaggcatgttcggagaggtgatggaggccaagaaggccatgtcttccgagcagctctccgagctcgccgccatcgatcccaagcgcgccaaaagaattattgcaaacaggcaatctgcagcacggtcaaaggaaagaaaagctcgatatataacagaattggagcggaaggttcaaactcttcagacagaggctactactctttcagcacagctgacactattccagagagacacaactggactttcagcagaaaatgctgagctcaagataaggttgcaggccatggagcagcaggcccaactgcgtgacgctctaaatgatgcactgaggcaagaagtggagaggcttaagatagcaacgggcgagatgtcgaagtccaataacgagcatttcaatatgggaatgcagcacgtttcctacagcccttcattcttccagctctcggagcaacacacagtgcagcagcatggaaacattcagctgccgcaccatttccaacagcctccgctgaatgtcccgagccaccagatgctatcccaccccaactccctctcgaacatggtgcagcaagactctcttgggcgtctccaggggctggacattgggaaaggctccatggctgtgaagtcggaggctgaggtcgtggtgaagtcagagggcagctctatatctgcgggtgaaagcaacaccaccttc

SEQ ID NO: 5575 - DNA, 543 bp, Zea mays
atgaccattacaaggatcctaagacgaggtgaacttcgtaacggccttagtgccctcggagacggcgtgcttggcgagctcgccggggaggacgaggcgcaccgaggtctggatctcgcgggaggtgatggtgggcttcttgttgtagcgcgccagcttggcggactcggccgcgagcttctcgaagatgtcgttgatgaaggagttcatgatggacatggccttggaggagatgccgatgtcggggtgcacctgcttcagcaccttgaagatgtagatcttgtaggtctccacggacttcttcgccttctttttccccttcttgccctcgccgccctccttggacttgcccgccgggaggcgcttctcggccttgggcttcttccccgccggagccttctccaccttctctgtcgcgggctcctcctccgcgggcttcttggccgccggcttcttctccgccttgggtgccatctgtgcggcggctgcgggaggtcgggactcgcgagggtgagaggctgcggcgaattgcctaggttggtt

SEQ ID NO: 5576 - DNA, 471 bp, Zea mays
atggccggaggagatgacctgaagctgctgggcctgtgggcgagcccgtacgtgctgcgggtgaagctcgcgctcagcctcaagggcctgagctacgagaacgtggaggaggatctgagggacaagagcgagctcctgctcaagtccaaccccgtgcaccagaaggtccccgtgctgatccacggcggcaagcccatctgcgagtcgcaggtcatcctgcagtacatcgacgaggccttcgccggcaccggcccgtccctcctccccgccgacccctacgagcgcgccgtcgctcgcttctgggccgcctacatcgacgacaagatgctgcccgcctggaaccagtcgacgatgggcaagacggacgaggagaggcccgatgggaacaaccagcccgccgtgacggcggaccacctggagggcccccctgagggcctgtcttggtgcacggaaactccttttcttcgttgg

SEQ ID NO: 5577 - DNA, 1599 bp, Zea mays
atggaccaggtggggcggaagaagtacgtcaagcaggtgacgggccgccacaacgatacggagctccacctcgccgcgcagcgcggggacctcgaggccgtgcgccagatcatcgccgagattgacgcccaaatgaccggcaccggcgaggagtttgacaacgaggtcgccgagatccgcgccgctatagtgaacgaggccaacgagatggaggcgaccgcgctgctcatcgccgccgagaaggggtttcttgacatcgtcgtcgagctgctcaagcactccgacaaggacagcctcaccaggaagaacaagtccggattcgatgctctgcacgtcgctgcaaaagagggccacagagatattgtcaaggtacttctggaccatgatccatcccttgggaaaacgtttggccaatcgaatgtgactcctctcataactgcggcgattagaggccacactgaggtggtgaacctactgctggagcgagtttctgggttggttgagttatcaaaagcgaatggaaagaatgccttgcactttgctgcccggcaggggcatgtggaaatcgtgaaggctttgctagatgctgatacccagcttgctcggaggactgataagaaaggccagattgctctacacatggcagtaaaaggtactaacccggaagttgttcaagcgcttgtgaatgccgatccggcaatagtcatgctacctgacagaaatggcaacttagctctgcatgttgcaaccagaaagaaaagatcagagattgtaaacgtgcttctgcttctcccggatatgaacgtgaatgcgttgactagggaccggaagaccgcattcgacatcgccgagggcctcccactatcagaggagtcccaagaaataaaggagtgcttgtcccgcgctggcgcggtcagagcaaatgagctgaatcagcctcgggatgagctcagaaaaacagttacagagatcaagaaggacgtgcatactcagcttgagcaggcgagaaaaaccaacaagaatgtctacggcatcgcgaaggagctaaggaaactccacagggagggcatcaacaacgcgacgaattcagtcacggtcgtggcggtgctcttcgccacagtggcgttcgccgcaatcttcacggtgcccggcggcaacaccgacgacggcgtagcggtggccgtgcacgcgacatccttcaaggtgttcttcatcttcaacgccgtcgccctcttcacgtcgctagcggtggtggtggtccagataacggtggtcaggggcgagaccaaggcggagaggcgggtggtgggggtcatcaacaagctgatgtggctggcctcggtgtgcacgacggtcgcgttcatatcctcctcgtacatcgtggtggggcggcacttcaagtgggcggcgctcctggtgaccctgatcggcggggtgatcatggccggcgtgctcggcacgatgacgtactacgtggtgaagtccaagcgcgtgcgcaagatcaggaagaaggtgaagtcgacgaggaggagcggctcgaactcgtggcaccacaactcggagctctcggattcggaggtcgaccgcatctacgccata

SEQ ID NO: 5578 - DNA, 1011 bp, Zea mays
atggagccgttcgtgatcgccaccaaccggcagctcagcgtgacgcaccccgtgcacaggctgctgctgccgcactaccgcgacaccatgaacatcaacgccctcgcgcgccagaagctcatcaacgccggcggcatcttcgagatgaccgtcttcccgcgcaagtacgccatcgagatctcctccaaagtctacggcagctggaacttcaccgagcaggccctccccgacgacctcatcaagcgaggcatggccgttccagatccgtcgagcccctacaaggtgcggctgctgatcgaggactacccgtacgcctcggacgggctggccgtgtggcacgccatcgagcagtgggtgacggagtacctggccatctactaccccaacgacggcgtgctgcaggccgacgtggagctgcaggcgtggtggaaggaggcgcgcgaggtcgggcacgccgacctcaaggacgagcactggtggcccaagatgcagacggtgccggagctcgtgaaggcctgcaccaccatcatctggatcgcgtcggcgctacacgctgccgtcaacttcgggcagtacccgtactgcgggtaccacccgaaccggccgtccgtgagccggcggcccatgccggtgccgggctccgacgcgtacaaggagctggagaagaacccggagaagttcttcgtgcgctccatcaccgcccaattccaggccgtcgtcggcatctcgctgctggagatcctgtccagccactcctccgacgaggtgtacctcggccagcgcgacaccaaggagtggacgtcggacgccaaggcgcaggaggcgttcaagcggttcggcgcgcggctgaccgagatcgagaaacgcgtggaggccatgaacaaggacccgcgcttcaagaaccgctacagcgcggcccagttcccctacaccctgctcttccccaacacctccgacaagggcgataacaccggcgtcaccgccaagggcatccccaacagcatttccatc

SEQ ID NO: 5579 - DNA, 306 bp, Zea mays
atgaacgggttcaccaccacgcacgccacgggccgcccggcccgtgcctgccgccccagcagctcggccagcgccggcgggccgtccttggcgatgtggcgcatgaggtcgtccaggtcaggcccggggtcctcgtcgtccatgaactcgaaccggacgcggccccggcccaccggcacgccgtcgccgccggccgatacgcccgcggacgcggtgagcttcgccccgatgctggagagcgaggagaaggtcacaagggggcccttggccgcgatgcgcttggccaggcggaccatcgggttcacg

SEQ ID NO: 5580 - DNA, 387 bp, Zea mays
atgcagaagagtgagatgctgcaggagtccaatatctccaagttcaagtcccaagtgcagagctcgcaggaaaaccatttctctttactacagcgggagactgagaaacttcgcggagatattgataagatgaggagtgaactgaagtatgagatcgacaaggtcaccgcaggacagcgattggatctgaatcttgaaagagggcgcatacgtgatgagcttgccaagcagaatgaggaaaccactgagcttaccacaaagcttgacaaggaaatccactcactgaaggcccagttggaggcagcaaagtacgatgtcatcaagtactgcataggtaccattgtttcgatctcagccgtcggcctcgccgtcctccgcatcgtgatg

SEQ ID NO: 5581 - DNA, 654 bp, Zea mays
atggcggcgacaatggcagtgacgacgatggtgacgaggagcaaggagagctggtcgtcattgcaggtcccggcggtggcattcccttggaagccacgaggtggcaagaccggcggcctcgagttccctcgccgggcgatgttcgccagcgtcggcctcaacgtgtgcccgggcgtcccagcggggcgcgacccgcgggagcccgatcccaaggtcgtccgggcggccgacaactgcgacatcgcgcgccagcttggcgccgccgttcccgggcagcaggccgcctgggaggcggaggaagaggcagcgaagaggaggaagcagaagggcggcggcagcaagaagcagcagcagctgggcgatctgagcctgaggaaggtcagggtcaagatcgccaacccgcacctgcggcgcctggttagcggcgccatcgccggcgccgtgtccaggacgtttgtggcgccgctggagacgatccggacgcacttgatggtcggcagcatcggcgtcgactccatggccggggtgttccagtggatcatgcagaacgaagggtggaccggcctgttccgcggcaacgccgtcaacgtcctgcgcgtcgctccgagcaaggctatcgagcatttcacctatggacacggcccagaaagtccc

SEQ ID NO: 5582 - DNA, 867 bp, Zea mays
atgcctcaactaatcctcaaacgccctgaggttattgtttacggctgtgaagcctccgtccaccatgaggttgaccgcgctgacgtacctcgcctcgtcgctggccaggtagagcaccgcctgggcgacgtcctcgggcatggcgtcgacgcccttgaggttggcctcgccgccgacaaaggccaggaagtccttgagcgcgtcatctgcgcgcgcgccctggggcaggtgcggcatcgacagcgccgtgggcacggcatagggggacacgcagttgacgcgcaccccgtggcggccgagctccgcggcgacgctcttggtgagcccgaccacggcgtgcttggacgccgtgtagacgtgcgggcccgtcccgccgatggcgctggccacgctggccagcgacacgatggagccccgcttccgcgggatcatagcgcgcgccgcgtgcttcatccccaggaacacgccgtgcacgttgacgtcgagcaccctgcgcgcctccgcgaagtccacgttgcggatgtccgtcaccttggtgcccgtcacgccggcgttgttcaccatcacgtccagcgcgccgaaccgctccgccgcagcgtccacggcgcggctcacgtcctcctccgacgtcacgtcgcagtggacgaacatggcgccctgcgcgtcacctcccagggcgtcgcgcagctgctgcccagcctcatcctggatgtccgcgatgcagaccttggcgccgtgctccatgaagaggcgaacgatggcctcaccgatgccggtggcgccaccagtgacgagggccaccttcccttccagccgcttactcgaggaggagaaggacggcgaggagcccgcggcggccatcgtctt

SEQ ID NO: 5583 - DNA, 558 bp, Zea mays
atgaagatgttcgccaacttccaccgccgcgacttcaacttcagcttcctgggcgagcgggagttctacgagcggcggcgcttcttcgaggagttcacggagctgaaggcggagccggcgagcgcgttcctggacgcgaggagcccgcggtggggcgggctcggcaagttcctgcgcgccaagtacctgtcgctggtgcacgcgcggatggagacggccttcttcgggcggctggagcagcgcggcatcgtgagcgccgggcccgggttcccggagagctcgtggttcgcggacttcgcggagatggcgcgccgcgtgtggctgctgcactgcctcttcttcgcgttcgacggcggcgccgaggaggacggcgcgtccatcttccaggtgcgcacgggggcgcgcttctcggaggtgtacatggagagcgccagcgacgggagcgccggcgacgacgccgaggaccgcgtggtcggcttcaccgttctgccggggttcagagtcgggcggacactgatccagtgccgcgtctacctgtccaaaccggggcggcggccg

SEQ ID NO: 5584 - DNA, 558 bp, Zea mays
atggcgcccaagaggagcagcgaggagcgcgcggcggcggagcaggagcagccgaggctccgcggcgtgcggaagcggccgtggggcaggtacgcggcggagatccgggaccccgtgaggaaggcgcgcgtgtggctcggcaccttcgacacgcccgagcaggccgctcgtgcctacgacgccgccgcgcgcaggctccgcgggccgcgcgccaccaccaactaccccggcgacgtcgtccgagaagcgccgtgcacggccccggctctggctgcgagcgcgagcggcagcaccgagtcgtcgtcgtcgtcgtcgtcaagggacgacggccacccgccaccgccgctgcctacggcgccgtcgtcgctcggcctgggcctcgggctcttcccggcgacggtggccacccagccgtgcctgttcctggacccggcgccggtggagagggaggaaggggagcgggagcggagctgctgctcccggtcgccgccgtcggtgctggcgggcctcgggttcgacttcgacctcaacctgcctccgcccgccgagatggtcatg

SEQ ID NO: 5585 - DNA, 1158 bp, Zea mays
atgctgctcagccgctacgacaccaagcgcgtcgagggcgccttccgcgccgcccagaccgtgctcatcgtcgaggacctcgttaccagcggcgcctccgtgctcgagaccgtcgccccgctccgcgccgaggggctcgtggtcgccgacgccgtcgtcgtcatcgaccgcgagcaaggtgggcgcgagaacctcgccgctagcggggtcgcgctgcactcgctcatgaccctcacggagatgctcgccgtgctggcgaggcacgggaaggtcggcgaggagaagatcgcggaggtcaggcggttcctccaagccaacaggaaggtggcggtgcccggggtgcctgctgggccacccaagccgtcggctactgctcggaggaagtcgtttgcggagagggcggggttggccacgaaccccatggggaggaggttgttcgaggtgatggaggcgaagcagagcaacttgtgtgtcgcggctgatgttgggacagccaaggagctacttgagcttgctgacaaggttggtccagagatttgtatgctgaaaacacatgttgatatcttgtctgattttacaccagattttggggccaaccttcgcacaattgctgggaagcacaactttctgatctttgaagaccgcaagtttgctgacattgggaacacagtaactatgcaatctgaaggaggtatattccgcatcttagactgggcggatattattaatgcgcatatagttcctggacctgggattgtagatggcttgaagctcaagggtttgcctaaaggaaggggcctacttttgcttgctgaaatgagctcagctggcaaccttgcttatggagactacactgctgcggctgtaaagattgccgagcaacatcctgactttgtaataggatttatatcagtgaatcctgcatcttggtcaccagcaccgtcaagcccagcatttatccatgccactcctggggttcagatagctgctggaggagatgcccttgggcaacaatataacactcccttttctgtcatcaacgacagaggtagtgatataattatagtcggacgagggattataaaggccagtaaccctgtagagaccgcgagacagtatcgcatggaggggtggcaggcgtatcaatccggcttttct

SEQ ID NO: 5586 - DNA, 693 bp, Zea mays
atgtcctgctgccccgcgcctgacactgccgcggccggcgccggcgccggcgcaggcatgtcggtgccgtgcccgtgcagcaggttccagttacgccacggggatctgaagtctggtcctgaggccaccgggtcggccgacaccggcgctcacctcgccagcaagcgccactcgttcgacctcggcaagctcccgggcccgggctcgctgccagtgccggcgtcggcgtcggcgtcgtcgagcgccgcccggcgcttcgtcggctctgtctccgcgagcgagatcgagcagtcggaggactacacccgcatcatcgcgcgcggccccaaccccaagacgacgcacatcttcggcgactgcatcctggagccccgtacggtcgggtgcggtgacagcaaggccgtggagtcgggggaaggaggcgccgggtgctacttcgtggtcaagcgcgccgccccgggcgccggtgacttcctcagctcctgcttcgcgtgcaagaagaagcttgaaggcaacgacatttacatctaccgcggggagaaggcgttctgcagcgccaattgccgggaccaggagatccagctggaggaggaagccgagaacaacacgagcagcggctcccctgggtcctcctcctcctcctcgtcgtcctccaacgacgacatcttcatggccggcatggtggtcgcgacg

SEQ ID NO: 5587 - DNA, 633 bp, Zea mays
atgaacgtatgctggctttcgggcggtgtctcgatgaacttctggtttttgacggtcaggtccccgaccagcacggtcgtcgtcgctgaagaacccggcgatcgagccggagccgtaggtgatcttgcaggtctcgccgtccgccttgtacgtgctagacttggccgacttgtatctgtggtgcaggtagcaggcaatcgagaagtagcatctggaggaggggacccagaggttggagctgccggtgtcgaagatgacggtgaagttctgcggcggcgtgccgatgccgacgaccccgtagtactgggtgttgaggtagtcgacgagagggacgtcgccgccgccggaggccccgagacggcttgcctcctgctgcctcgcggccttggccgccgccagcgcgcgctggtcgagcccgccgccgcgcctgctgagcccgaccctcagcaggccgccggcgccggcgccagcgccgtgaggggacgcgtgcagcagcagcgcgcacgacagcgcccacaggcaggcggctgctgccggcagcaggaggtggccgcgcccgcgccccatgatccttgttgtcttgttagcgtgttctaccttctttttcttccgaacaagtgctggagagcggtt

SEQ ID NO: 5588 - DNA, 693 bp, Zea mays
atgctccgcaagcacacctacttcgacgagctcgcgcagaacaagcgcgccttcgccgccgcgtccgcgtccgcggccaccgcctcgtcgctggccaacaacccttcttcctacgcgtcgctctcccccgcgaccgcgacggccgccgcgcgggagcacctcttcgacaagacggtcacccccagcgacgtgggcaagctgaaccggctggtgatcccgaagcagcacgccgagaagcacttcccgctgcagctcccatccgccggcggcgagagcaagggcgtgctcctcaacctggaggacgccgcgggcaaggtgtggcggttccgctactcgtactggaacagcagccagagctacgtgctcaccaagggctggagccgcttcgtcaaggagaagggcctccaagccggcgacgtcgtcggcttctaccgctccgctgccggcgccgacaccaagctcttcatcgactgcaagctgcggcccaacagcgtcgtcgtcgcctcgacggcaggcccgtcgcctccggcgccggtggcgaaggccgtgcgtctcttcggcgtcgacctgctgacggcaccggccaccgccgcggcgccggcggaggccgtggccgggtgcaagagagccagggacttgggttcgcccccgcaggcggcgttcaagaagcagctcgtggagctggcactagtg

SEQ ID NO: 5589 - DNA, 939 bp, Zea mays
atgatgagcggtagctcgcctccgccgccctcgcttcctgccgggagtggaggcttcttcaggggatacacaaagctgtgcaagggcctcgccgtcatattgctcattgtgcaccttgtagtccagttgtttccgtccgccgtcacctatctcgcgcttatccctggaagaacgatcccttttgcttggaacctgataactgcaggctatgtcgagcaaacaattccagggatggttgtcagcatcattggccttcttttatttgggaagttgttagaacctctatggggttcaaaagagttatcaaagttcatttttatcgtcaacctttcaacttctgcttgtgttttcatgactgctattgtgctgtactatataactcagcaagagatctacctctatactcctttttctggattttatggggttctatcaggattgttggtgggcattaaacagcttttacctgatcaagagcttaatctttttgtgctaaaaattaaggcaaagtggattccatctcttgttgcattgatatccattcttggaagcatcttcatatacgactttatgtcttacctcccagttctgttgtttggcatgtatatgagttggatctacctccgttactttcaaaagagacttgagaccagcctgaaaggggatccaagtgaggagttctctttctcaagcttcttccctgaatttgtaagaccatttctcgacccaatagcatctgtattccataggttactttgtggaagatctgatgccaggggagaaacattagacacctcaccattacctggttcagattcgtttgaggcaaacaggaggagagagaggggtcaacgggcactggagcaaagattagctgagaagctggctgcagtcaggagttcagagggcggcacatcactggatgccgctgacaaagtt

SEQ ID NO: 5590 - DNA, 927 bp, Zea mays
atggagaccatccaggaggccgaggtgcccggttcgacgtccgccgccgcggccgatcaccggacgtacagcaaccccgcgttccaagtgtccgggaacattgaggaggcttggtacgattccttggcgatgagcgagtcggatgccgaagacgatttccacagcgtgcaagatgattctttttcattgaatggcttcgagaacgaagctgcattgagcatgagagatggcaacggtgggagcttcaatggagctgcgcaatcaggcgagcagcaacataaaaagccaaagtccagcgaactgtcaaaggggagcttggagaatggtgtgaggtcgtccatgagcaacgaggatgcggtgagtttttctggtgcggacaacactcacggtggagagaggatactggaagtttgcgggcttctgccaaataattgtctaccctgcattgcctctgctgttggggtaagcgagaagaagagaactctttcctcgagccctactcattcaatgaggatgccttctttgaagctttccttcaagaagaagtcaggggaagctcatccatcttccacactactatctacgaaggatttcctggaaaggcctctagcaggttctcaagtacagttgtgccttgctggaaacaatatgcccaacagttggactcatattgatcctggtacattccgagtccgtggagcaaactatttagggataagaaaaaagagcttgctccaaattatgctgcatattatccatttggagttgatgtgtacttatcgccacagaaactcaatcatatatctcgatttgttgaacttcctgatattcaactctccagcaagctcccacctcttttggtggtcaatgtacaggtgccattgtatccagcttcattatttcagaatgagactgatggggaaggga

SEQ ID NO: 5591 - DNA, 480 bp, Zea mays
atgccgacgccttacgttgagcaccagaaggccgtcactatccgcaacgacatcaaccttaagaaggagacgcttcggatcgagcctgatgaagaacgccctggccgcttcctcgtcgccttcacctttgacgccacggtcgctggcagcatgactgtttacttctttgcaaaggaagagctcaactgcaatctaacaacagtgaaagaagacctaattaagcccattactgttagcttcaaagagggtcttggtcaaaaattcaggcaaccttcaggaacaggaattgacttttcagtgtttgaagaatcagatttattaaagcagggggacatggatgtatatccacttgcagttaaagctgaaacaacattgtctgttgatcacccaccagaaggggatgaccaaaagatgataactcctaactcacagatcacccagggcccgtttttgaaaagaaagaaaatggggattatcaag

SEQ ID NO: 5592 - DNA, 342 bp, Zea mays
atggcggccgtgctgaggagagccgtggcgcagtgcttcgcgtcgtcgtcgtcgtcgtcgccggcgacgttcgggctccggcggttcctgcaggagcagccggcgttccgccccgccgtgccgcccgaccgcttcatgcccctggccgaccggatccgggacctcggggtcggcgtcgcattcccgcggatcaacctcgacggcctcgtgccgcccgcgccggcgccggcgccggccaagcgggagccggacgcggcgctgcccgcggcgagcctcacggtggaggaggcgcgcaaggtgttgcgcgccacacagatggaggcggcccgcgcgcggattcgg

SEQ ID NO: 5593 - DNA, 912 bp, Zea mays
atggaagccagcagcaagaagctccaggcgttcatcctcacgctgctgctggtgctctccaccgccgtgactcccatcctctcgctgtcagtgccagacgacgaggtagcctgcgactgcgataaacccaaggcgcccaagccgtcgcacccgcccaagaccaagccctcccacccgtcgccgtcgccgaagcccaagaatcccaagccacccaagggcagcaccgggtacccagcgccggggcaccaaccgcccaagagcccctcctaccccccggtcgtcggccctcccaagggccccgtcacgcgcccgccagtcatgcgtccgccggtcgtcggtcctcccaagggccccgtcacgcgcccgccggtcacgcgtccgccggttgtcggaccaccggtgacctacccgccgatcaccggccctccgacgacgccgcctgttgtcggaccaccggtgacctacccgccgatcaccggccctccaacaacgccgcctgttgtcggcccaccggtgacctacccaccgatcactggcccgcctgcgacgacgcccccggtcaccggtccgcccgtgacctaccctcccggcggaggcgggggaagctcgacgccgtgcccgccgccaccgagcccgacgccgacgccgtcgtcgcctacgtgcccggctgactcgctgaagctgggcgcgtgcgtggacctgctgggcgggctggtgcatatcggcctcggcgaccccgtggtgaacaagtgctgcccggtgctggaggggctggtggagctggaggcggccgtgtgcctctgcaccaccatcaagctcaggctcctcaacatcaacctctacctgccactggcgctccagctcctcctcacctgcggcaagacgccgccgccgggctacacctgcaccgtc

SEQ ID NO: 5594 - DNA, 1068 bp, Zea mays
atgcccaagggcgtcatgctcacgcatcgcagcctcgtcaccagcgtcgcgcagcaggtggacggcgagaacccgaacctgtacttcagcaaggatgacgtggtgctgtgcgtgctgccgctgttccacatctactcgctgaactcggtgctcctggcggggctgcgcgccggctgcgccatcgtgatcatgcgcaagttcgagatcggcgcgctggtggagctggtgcgcgcgcacggcgtgaccgtggcgcccttcgtgccgcccatcgtggtggagatcgccaagagcccccgcgtgggcgccgccgacctcgcctccatccgcatggtcatgtccggcgccgcgcccatggggaaggacctccaggacgcgttcatggccaagatccccaacgccgtgctcggccaggggtacgggatgaccgaggcggggcccgtgctggccatgtgcctggccttcgccaaggagccgttcgaggtcaagtccggctcctgtggcaccgtcgtcaggaacgcggagctgaagatcgtcgacccagacaccagcgcgtcgctgggacggaaccagccaggcgagatatgcatccgcggcgaacaaatcatgaaaggttatctgaatgatccagaggcgacaaagaacaccattgataaggacggatggctgcacaccggggacattggttatgtggacgatgacgacgagatcttcatcgttgacaggctgaaggagataatcaaatacaagggcttccaagtacctcctgcggagcttgaagcccttctcatcacacatcctgaaatcaaggatgccgctgttgtctcgatgaaagatgaagtcgccggcgaagtcccggtggcattcattatacgcagtgaaggctctgagatcagtgagaacgagatcaagcagtttgttgcaaaggaggtcgtgttctacaagaggatcaacagagttttcttcacggattctatcccgaagaatccctccggcaagattcttaggaaggacctgagagcgcggcttgccgcgggcatcccaagcagtgacaacacacagtccaaaagt

SEQ ID NO: 5595 - DNA, 240 bp, Zea mays
atgaggacgtgccagtggttcttgacggcgttgtcggtgcggcccgggaagaggcgcgcgatgagagcccacttgttgccgtacgcgcggtgcgccgccaggagccgctcctcctcctcctccgagaaggcgcgccggttgatccgcgggtccagctggttgaaccaccgcaggcggcagctcttccctgatctgccgtccagcctctcggcgatgaggttccagttctggggcccaaac

SEQ ID NO: 5596 - DNA, 1086 bp, Zea mays
atgcaccagcacgagatactagccatcatgcgcctgtcgtccctcctcctcgtcgtggccgccctctcggcgcgcgccgcggcgcagcaggtgccgccggtgggcggcagcgctctgaagccggactactacagccagtcgtgcccgcgcgcggagcggatcatcgcggaggtgatgcagacgaagcagatggcgaacccgacgacggccgcgggcatgctgcgcgtcttcttccacgactgcttcgtcaccgggtgcgacgcgtcggtgctgatcgcgtccacccagttccagaagtcggagcacgacgcggagatcaaccactcgctccccggggacgccttcgacgccgtggtgcgcgccaagctggccctggagctggagtgccccggggtggtgtcctgcgccgacatcctcgcgctggcgtcgggggtgctggtcaccatgaccggcgggccccggtacccgatcccgctggggcgcaaggactcgctgtcgtcgtcgcccacggcgcccgacgtcgagttgccacacgccaacttcaccgtggaccgcctcatccagatgttcggcggcaaggggttcacggtgcaggagctggtggcgctgtccggcgcccacacgctgggcttctcccactgcaaggagttcgccgaccgcctctacaacttccgcagccagggcgggaagccggagccgttcgaccccagcatgaacccgtcctacgccagggggctgcaggacgtgtgcaaggactacctcaaggaccccaccatcgccgcgttcaacgacatcatgactcccggcaagttcgacaacatgtacttcgtcaacctggagcgcggcctcggactgctcagcaccgacgaggagctgtggacggacccccgcaccaagcccctggtgcagctctacgcgtccaaccccactgccttcttcaccgacttcggccgcgccatggagaagctcagcttgttcggcgtcaagaccggcgccgacggcgaggtcaggcggcgctgcgacgcgtacaacagcggccccgacgttggcggcgccatgcctatggctatgcccatgcccaagatg

SEQ ID NO: 5597 - DNA, 522 bp, Zea mays
atgtcgtctcctgaccatcggtcccggttctaccagttttcaagacgaacgacaactcgtcggtggtgcagaccaccaacgccacgacatacgggctctgcgacgccagcgacgacctggcggagacgacgtccatctacggcggcggcggcggcgggggcggcggcctcgagcagaacagcaccatcgcggtggcgctcaccgccgagggcgccaactacttcttctccgaggccgacgggggcgcgcagtgccagcaggggatgcggttcgagatcaaggtcgagcacggccggggcctgccgccgtcgctactgcaccagccgccggcgcccaagggccgcgtcctcgcgccgccgccggcgggcacggcgttctcgggcaccggcggggtcgagcccggcgacggcgccggggacaacggcggcgctggcacgagcggcgcgtgcagggcggccagcggccggttcttgggggtggtggctgctgctgctgcggctctggccgttttggttctttgag

SEQ ID NO: 5598 - DNA, 2475 bp, Zea mays
atggcgggcctcgcgcccaaaaccaaggtgctcagggacggcaagtggaaggaagaggaggcgtccatcctcgtgcccggggacatcatcagcatcaagctgggtgacatcattcccgccgacgccaggctgctggagggcgacccgctcaaggttgaccaggcggcgctcacgggcgagtcgctgcccgtgaacaagcacccgggccagggggtcttctcgggctccacagtcaagcagggcgagatcgaggccgtcgtcatcgccaccggcgtgcacaccttcttcggcaaggcggcgcacctggtggacagcaccaacaacgtgggccacttccagctcgtgctcacggccatcggcaacttctgcatcatctccattgccgtcgggatggtcatcgagatcatcgtcatgtacccgattcagcaccgcgcgtaccgcgatggcatcgacaacctcctcgtcctgctcatcggcggcatccccatcgccatgcccaccgtgctctccgtcaccatggccatcggctcccaccgcctgtcccagcagggcgccatcaccaagcgcatgaccgccatcgaggagatggccggcatggacgtgctctgcagcgacaagaccggcaccctcaccctcaacaagctcaccgtcgacaagaccctcatcgaggtgtgcggcaagggcgtcgacaaggacatggtgctcctctacgccgccagggcctcccgcgtcgagaaccaggacgccatcgacacctgcatcgtcggcatgctcgccgaccccaaggaggcccgcgccggcatcaaggaggtccacttcctccccttcaacccggttgagaagcgcacggccatcacctacatcgacggcaacggcgactggcacagggtcagcaagggcgcccccgagcagatcatcgagctgtgccggatgagcaaggatgccgagaagaagatccacgccctcatcgacggctacgccgaccgcggcctccgctccctgggcgtgtcgtaccagctggtccccgagaagagcaaggagagcgccggcgagccgtggcagttcatcggtctcctcccgctgttcgacccgccgcggcacgacagcgcggagaccatccgccgcgcgctccacctgggcgtgaacgtgaagatgatcaccggcgaccagctggccatcggcaaggagacggcgcggcgcctgggcatgggcagcaacatgtacccgtccaccaccctgctgggcgacaacaagaccggcgagatgggcggcctgaacatcgacgagctgatcgagaaggccgacgggttcgcgggggtgttcccggagcacaagtacgagatcgtgaagcggctgcaggaccggaagcacatctgcggcatgaccggggacggcgtgaacgacgcgccggcgctgaagaaggcggacatcggcatcgcggtggacgacgcgacggacgcggcccggagcgcgtcggacatcgtgctgacggagcccgggctgagcgtgatcgtgagcgccgtgctcaccagccgcgccatcttccagcgcatgaagaactacaccatctacgccgtgtccatcaccatccgcatcgtgctgggcttcctgctcgtcgcgctggtctggaagttcgacttcgcgcccttcatggtgctcatcattgccatcctcaacgacggcaccatcatgaccatctccaaggaccgcgtgaagccgtcgccgacgcccgactcgtggaagctcaaggagatcttcgccacgggcatcgtgctagggacctacatggcgctcgccacggcgctcttcttctacctggcgcacgacaccgacttcttcaccaacgccttcggcgtgcggtccatcaaggagaacgacaaggagctgatggcggcgctgtacctgcaagtgagcatcatcagccaggcgctcatcttcgtgacccggtcccggagctggtccttcgtggagcggcccggcgcgctgctggtgatcgccttcctggcggcgcagctggtggcgacgtgcatcgccgtgtacgccaactgggagttctgcaagatgcagggcatcggctggggctggggcggcgccatctgggcgttcagcgtcgtcacctacttcccgctggacgtgctcaagttcgccatccgctacgcgctctccggcaaggcctggaacaacatcaacaacaagacggccttcaccaaccgcaccgactacggcaagggcgagcgagaggcgcagtgggccacggcacagaggacgctgcacggcctcaaccaggccaccgccacctccgacctcttcggcgacaaccagggctaccgcgagctgtcggagctcgccgagcaggcggccaagcgcgccgaggtggccaggctcagggagctgcacacgctcaagggacacgtcgagtccgtcgtcaagctcaagggcctcgacattgacaccattcagcagagctacaccgtg

SEQ ID NO: 5599 - DNA, 549 bp, Zea mays
atgccacggaccgcatggtgtccatcctggcggacgagcacatcgtggacctgcagaacctcgtggtccgcctcacctttgacaacatctgcggcctcgccttcgggaaggaccccgagacgctcgcccggtgcctccccgacaacgccttcgcctccgcgttggaccgcgccacggaggccaccctcaaccgcttcatcttccccgagtgcgtctggcgctgcaagaagtggctgggcctcggcatggagacgacgccggcgcgcagcgtccgccacgtcgaccgctacctctcggctgtcatcaaggcgcgcaacctcgagctctccgcctccttgccgccgccgccacgaggaaggacctcctctcggccacgccgcacgacgacctcctctcgcgcttcatgcgcaaggggacctactccgacgaggcgctgcagcacgtggcgctcaacttcatcctcgccggccgcgacagctcctcggtggcgctctcctggttcttttggctggtctccacgcaccccgccgtggagcgcaagaatatttg

SEQ ID NO: 5600 - DNA, 678 bp, Zea mays
atggacaactcgccccactcgtacctcgccttcgacggcgccgaggagttcgcccgtgcgcagggcctggagaccgtggacaacagctacttcatcacggatgacaacgtcggcatgctcaagctcgccaaggaggccggcagcatcctgttcgactaccggatcccgctggcggggacggacacgtgcagcgcgctggcgggcgcggcggacagcaacggcggcggcgtgcacaaggcggggatggtcatgaacgggctgcccatcagcgtgtacgcgccggagacggtggggtgcgcggtggtggacgcgtcgggggcctgcgcggcggccacgtccacgggcgggctcatgaacaagatggccggccgcatcggggactcgccgctcatcggctccggcacctacgcgtgcggcgcctgcgccgtgtcgtgcacgggcgagggcgaggccatcatccgctgcacgctcgcgcgcgacgtggccgccgtcatggagtacaagggactgcccctgcagcaggccgtcgactactgcgtcaaggagcgcctcgaccagggattcgccggcctcatcgccgtctccggcaccggcgaggtggcgtacggattcaactgcaccggcatgttccggggctgcgccaccgaggacgggttcatggaggtcggcatctgggag

SEQ ID NO: 5601 - DNA, 963 bp, Zea mays
atggagttcgacgaatacgagtacctggagaaggcggtggagccggctcccccgccggccaatggttccggctccggcgagaaggaccgcggctcgcgtcgccgcgagggcgacgagggccgcatatcgaagcgctcccgctcgggggaggaccgcgagcggggccggcaccgcagcgttcgggaacaccgggatcgggataaggatgacgggaaggagaaggagaggagccgcgatagccgcgggaaggacagagacagggaagggagagaacgggagaaggagaggggggacaggcaccggcccagagagagggaggtggaacgggagcggaggagcctgagccgttcggagcggcgccgtatcgaggaagaggagatggtgagggagctggagatggagcgcgagcgcagcgagcgacaccactatcgcgaccgtgacgtcaggcgtaggaaagatgacggggcagagccagaagttgatccagaaagggaccagaggactgtatttgctttccagctatctctgaaggcagacgaaagagatgtttatgagttcttctcaagggctgggaaggttcgtgatgttcgtcttatcatggaccgaaactcaagacgttctaaaggagttgggtacattgagttttacgatgttatgtctgttccaatggcaattgctttgtctggtcaaccgctgcttggacaagcagtgatggttaagccatctgaggctgaaaagaacttagttcagtcaaatgcgacatcaggtggtgcggcttcaggtggagcaagaaagttgtatgttggcaatcttcactcaaatattactgaagaccaattaagacaggtatttgaaccatttgggcaagtggagcttgtacagcttcctctagatgcaatgactggactgtgcaaaggttatggctttattcagtttgcccggcttgaagatgcaaaagctgca

SEQ ID NO: 5602 - DNA, 534 bp, Zea mays
atgaaggagaccaccagggaggtcaagtgggagaagcggaagcggcagatacaacggcagaggagcagcatgcgcctgagcgaagccgacgacagggcaggtggcagcactgctgtctgtcctgttgacggcgaggcgagctcgagcgcggagcgggtggccactggtataaccgacggggacctggatgagctgaggggatccatggatctcggcttcaggttcgacgagcagaagggcggccaggacctctgcgacaccctccccgccctcgacttctatttcgccgtcaaccggcaggtgtcggagcccaggatgtcgtttcccacgagcacgagctcagggccgtctctgtcggccaccaagtcctcgcccaacctctgcggcacgcccagcccaggtagccctggtgcgcactctagtaacgccttggagtcatggaagatttgcaacccaggagataaccctctgcttgtgaagacaaggctcaggcactgggctcaagtagtggcttgttcagtgaagcactcgagc

SEQ ID NO: 5603 - DNA, 597 bp, Zea mays
atgatgcggaacatgtcgttgtacatcatcagctggaggcggcggcggagcacgacgccgccggccgcggcctcggggtccttcctcacgtcctccaccaccagccgggcctcctcctcccacccggcgcggttctgggccaccaccttgttggtgaagaaggggacggtcatgatgcgccgcatcttgcgccagtggtcgccgtacaccgtgaacaccatgtcctgccccttgcccgtgaagatgtcgaacaccacgttgcgggtgcgggagccgaactccacgccctgcgtgtggagcacctccttggccagctccggggtcgacaccaccaccaggttgcgcacgcccatgcgcagcaggaagatgtcgccgaaccgcttcgccatggccatcaggttgcggtggttcaggtcgtcgcccacctgcagccagtttcccaccacgggggcgcccgggggccccggtgggaggcggtaccgcttgccggtcagcttggccacggcgatggccaccacagccgcggcgaacaggcccagcagggccttctctaggagggcgaggtccatgctgtgctgcctgccggtccggccgggg

SEQ ID NO: 5604 - DNA, 651 bp, Zea mays
atgggagaagcgtgcagggacgcggcggctgcgggccggcagctgctgcaggacgaagcgggcggaggaggagggcgtcacgcggagaaggagctcgtcggtgacccgacccacgactcggccgtctcggcgaagctgtacgaggacgtgccggcgacgccgatgatggcgctcaaccacatctcccgcctgtgcgaatccgtcgacgcctccgtccggttctacgtcaaggcgctcggcttcgtgctcatccagcgcccgccggcgctcgacttctccggcgcatggctcttcaactacggcgtgggtatccacctcgtgcagcgcgacgacgcgcggcgggcccccgacgtgaggccggaggaggcggagctggaccccatggacaaccacgtgtcgttccagtgcgaggacatgggcgccatggagcggcggctgcgggagatgcgcgtgcggtacatgaagcggaccatcaacgaggaggaagggtcgcccatcgaccagctcttcttcagggacccggacggcttcatgatcgagatctgcaactgcgagaacctggagctcgtccccgccggcgccttcggccgcctcaggctgccccgcgaccgccacaacccgcccgtgcgcatggtcgccggcagcgacgag

SEQ ID NO: 5605 - DNA, 135 bp, Zea mays
atggtactcttctgctctatagaacctcttcgctggaacgatctcggtgacgatcttccggttcagaagcttctgctgcttctccagggactctcttgccgccttctcctgctctgggttatagtagtatatccc

SEQ ID NO: 5606 - DNA, 438 bp, Zea mays
atgacgacgagcctgaagaagaaccggaagaagcgcgggcacgtgtcggcggggcacggccgcatcggcaagcaccggaagcacccgggaggccgcggcaacgccggcggcatgcaccaccaccgcatcctcttcgataagtaccacccgggctacttcggcaaggtgggcatgcgctacttccacaggctccgcaacaagttccactgcccgtcggtcaacgtggagcggctctggtcgatggtgcccgccggcaaggccgcggaggcggccggcgcggaccaggccccgctcgtcgacgtgacgcagttcggctacttcaaggtgctcggcaaggggatgctgccgtccaggcccatcgtcgtcaaggccaagctcatctccaaggtcgccgagaagaagatcaaggctgccggaggcgccgtcctgctgaccgct

SEQ ID NO: 5607 - DNA, 390 bp, Zea mays
atggctccgtcgctcgcgtcgacggcggggctcccgagctgcggggcgcggcgcggcggccggtgcgtggcccgccgcgcgtccgcggttgcgactccggcgacggcgacggcgaggacgcactacgaggtgctcggggtcggggccggcgcgagccggtgcgagatcaaggcggcgtaccggcgcctggcgagggaggtgcacccggactgcggcggccgcggcgacgaggggttcatccgcctgcacgccgcgtacgccacgctcgcggaccccgacgagcgcgcgcgctacgaccgcgccgcggcggtccggagccggatcagggcggcgccgtcggggtccggggcggggttccggccgcgaaggtgggagacggaccagtgctgg

SEQ ID NO: 5608 - DNA, 729 bp, Zea mays
atgctgcgccacgccgcccgccgcctcgtttcccgcgccgtcgctccgcccaccgcgcgccgggcgctcgccacggcggaggtgcccgcggaggccgtcgaggactccacgttcgtcgaggcctggaaaaaggtcgcccccaacatcgagcccccagcgacgcccctctccctcatgcagccgcgcccgcccacgccagctaccatccctaccaagctcaccgtcaacttcgtcctcccctacaagtccgagatcgccaacaaggaggttgacatggtaattgtaccagctacaactggtcagatgggtgttttgccaggccatgttgccacaattgcagagctcaagcctggtgttctctcagtacatgaaggaaacgatgtgagcaagtactttgtgagcagtgggtttgctttcgtccatgcaaactccattgctgatattgtggctgttgaggctatccctgtggatcagatcgacccagcattggttcagaagggtctcgctgaattcactgccaagcttggttcggcctctactgacctggagaaggctgaggcccagatcggagtcgatgttcacagtgcccctcaatgctgcattgaccggttaattggtggcattttaaattgtcttgtctttttcatctacagttttagagtgagtttaagtttgcaaactcatgggcatgggatggagggaatgatcctaaataaattatactccatc

SEQ ID NO: 5609 - DNA, 1221 bp, Zea mays
atggtcaaccacttcgtccaggagttcaagaggaagaacaagaaggatatcactggcaaccccagggctctccggaggctgaggaccgcttgtgagagggcgaagaggactctgtcttccactgcccagaccacgattgagattgactcgctgtatgagggcatcgacttctactccaccatcacccgtgccaggtttgaggagctcaacatggacctgttcaggaagtgcatggagcctgttgagaagtgcctgagggatgccaagatggacaagagcaccgtccatgacgttgtacttgttggtggctccactaggatccccagggtgcagcaactgctccaggacttcttcaacggcaaggagctgtgcaagaacatcaaccccgatgaggctgtcgcctatggtgctgctgtccaggctgccatcctgagcggtgagggcaatgagaaggtgcaggacctgcttctgctggacgtcacccctctgtccctgggtctggagactgctggaggagttatgacagtgctgatcccgaggaacaccaccatccccaccaagaaggagcaggtattctccacctactcggacaaccagcccggtgtcctgatccaggtctacgagggtgagaggacccggacacgcgacaacaacctgctgggcaagttcgagctctccggcatcccccctgcaccccgtggtgtgccacagatcaccgtgtgctttgacatcgacgccaacggcatcctgaacgtgtctgccgaggacaagacaacggggcagaagaacaagatcacaatcaccaacgacaagggccgtctctccaaggaggagatcgagaagatggttcaggacgctgagaagtacaagtctgaggatgaggagcacaagaagaaggtggaggccaagaactcgctggagaactactcctacaacatgcgcaacacgatcaaggacgagaagattgcgtccaagctgccggccgatgacaagaagaagatcgaggacgccatcgacgcggccatcagctggctggacgccaaccagctcgccgaggcggacgagttcgaggacaagatgaaggagctggagagcctctgcaaccccatcatcgccaagatgtaccagggcgcgggtgaagacatgggcggcgctggcggcatggacgaggacgcccctgccggcagcggcggccctggccccaagatcgaggaggtggac

SEQ ID NO: 5610 - DNA, 1341 bp, Zea mays
atgggtaaagagaagtcccacatcaacattgtggttattggccatgtcgactctggcaagtcgaccaccacaggacaccttatctacaagcttggaggcattgacaagcgtgtgatcgagaggtttgagaaggaggctgctgaaatgaacaagcggtccttcaagtacgcgtgggtgctcgacaagctcaaggctgagcgtgagagaggtatcaccattgatattgctctgtggaagtttgagaccaccaagtactactgcacggtcattgatgcccctggacaccgtgacttcatcaagaacatgatcactggtacctcccaggctgactgtgctgtccttatcattgactccaccactggtggttttgaggctggtatctccaaggatggccagacccgtgaacatgctctccttgcgttcacccttggagtgaagcagatgatttgctgctgcaacaagatggatgcaaccactcccaaatactccaaggcacgttatgaagagattgtgaaggaagtctcatcctacctcaagaaagttgggtacaaccctgataagattgcctttgttcccatttctggttttgagggtgacaacatgattgagaggtccaccaaccttgactggtacaaaggcccaaccctgcttgaggctcttgaccagatcaccgagcccaagaggccttcagacaagcccctgcgtctgcccctccaggatgtgtacaagattggtggtattggaactgtaccggttggtcgtgtggagactggtgtcatcaagcctggtatggttgtcacctttggtccaactggcctgactaccgaggtgaagtctgttgagatgcaccacgaggcgcttcaggaggctcttccgggtgacaatgttggcttcaacgtgaagaacgttgctgtcaaggatctcaagcgtgggtttgtggcctccaactccaaggatgaccctgccaaggaggctgccagcttcacctcccaggtcatcatcatgaaccaccctgggcagattggcaacggctatgccccagtgctggactgccacacctcccacattgctgtcaagtttgctgagctcattaccaagatcgacaggcggtctggcaaggagcttgagaaggagccaaagttcctgaagaacggtgatgctggtatggtgaagatgataccgaccaagcccatggtggtggagacgttctcagcgtatcctccccttggtaggtttgctgtccgtgacatgaggcagacggttgcttttggagttatcaagagtgtggagaagaaggacccgaccggcgccaaggtgaccaaggcggctgccaagaagaaa

SEQ ID NO: 5611 - DNA, 462 bp, Zea mays
atggctttcgcagcagtgccttcccacgaggagcaggaggcgtggatcgcgaccgcctgtgacgtcgacgcgcgccgggcggaggtggaggtggaggaggcgcgcgagcaggctgctccggcgccggacgagccgtgcctgtcctcgttcgtggacatgtcggagatcttccccgccagcgtcacgctcagcagcggcggcgacgtggacaatagcggcaacaagccagacgaggaaacggccccgcgaccgcagctgttggccacgacggcgctggtgccggtgacggaaaagaagggcggctacgacgtggcccaccccgaccgcggcacggtgatctcgcgctacaaggagaagcggaagaacaggaggttcggcaagcagatccggtacgagtcgcgcaaggcccgcgctgacggccggatgcggatcaaggggcggttcgccaagtccggcgaggtc

SEQ ID NO: 5612 - DNA, 873 bp, Zea mays
atgtggagcgcggcgtggatgtactacgccacgggcaacaacagctacctcaccttcgccaccgacccgcggctgcccaagaacgccaaggccttcttcaacatcctcgacttctccgtgttcagctgggacaacaagctcccgggcgcccagctgctgctgtcgcggctgcgcatgttcctcaaccccggctacccgtacgaggagtcgctcgccggctaccacaacgccaccagcctcaacatgtgcatgtacttcccgcgcttcgccgccttcaacttcaccaagggcgggatggcgctcttcaaccacggcagggggcagccgctgcagtacgtcgtcgccaactccttcatcgctgcgctctacgccgactacatggaggccgtcaacgtccccggctggtactgcggtccaaacttcatgaccaccaacgacctccgtgagttcgccaggtctcagatcaactacattctcggtgacaaccccaagaagatgagctacgtggttgggttcggcagcaagtacccacggcacgtgcaccaccgtggcgcgtccacgccgcacaacggcgtcaagtactcgtgcaccggcggctacaagtggcgcgacagcaagaaagcggaccccaacctgctggggggcgccatggtcggcgggcccgacaagaacgacggcttcaaggactcgcgcaacaccttcgggcagaacgagccgacgctggtaggcaacgccggcctcgtcgcggccctggtggctctcaccagcagcggcaggggagtcggcgtaaccgccgtcgacaagaacaccatgttctccgccgtgccgccaatgttccccgccgcgccgccaccaccgtcatcatggaagcca

SEQ ID NO: 5613 - DNA, 1071 bp, Zea mays
atgtggaagatggaggaagggttattgattgatacatcccgtgcacttggtggcaccatccgggcgattgcagctgactcgaggcttttagtgagtggaggaactaatgcctatattcagtgttggagggccgttgaaggcaatggtcaattatttcacatctctggaagtggtaccgaccagaatgcggagtttcgcctctggggtcatgaaggtcctgtgacttgtcttgccctggattcactgaggatttatagtggttcttgggacatgactgttcgtgtttgggacagagaccagatggagtgtgtgcaaaagttcatgcatgcagactgggtttgggatcttgctctgcgtggaaatactgttgccagtactgctggtagagatgcatatgtatgggatatcagggctggcgagttaacaagcttaatttccaatgcccatgttggtagcgcatattcaattgcttggacacacctgccagatgtgctgtttactggtggagaggatggtgctattcgattgttcaatgtttctgatgtctgtgatgatgagggtgacattaaaccagtggcaacttgggtgccacattcaggtcctgttcattctcttgcttttgagtatccatggcttgtgtcagcctcgagtgatggcaggattgcacttattgatttgaggaagcttctgtcctccaaaagttcatcaaagggtctgcgtgttaagagagttgatggaagcgcaatagagcctccacagaggatgcttcatggcgttggatgtgatctcttctccatcgctattggtgcagataggattgtatgtgccggtgaggatggttctgttagagtctggaacttctcagaagcattggagattgagaggagggcacaggctctaaggagtttgaggcaggagaaccgcatcaggcggaggaaatcacaagcggagatgaatacaaatactagaaggcctgaccagtgttcaatagccatgaaaaagaaccaactgaagggtgataagagcgcaacttggcacaacaagcgtgccattaatgagaaggccaagtct

SEQ ID NO: 5614 - DNA, 1038 bp, Zea mays
atgtacatttcggtcccgctgctgctctacgtcggtgaaaggatgcttagagccttgaggtcaaatgcttataccgtgaaaattctcaaggtgtgtcttctacctggaaatgtgttgaccataacgatgtcaaagccctatggatttcgttacagaagtggacagtacatatttcttcaatgtccaataatttctccatttgaatggcatcctttctccatcacttcagcacctggagatgactacctcagtgtccacatccggacaaacggtgactggacacaggagctcaagcgcatatttgtggagaactacttctcgccgcatctcaacagaagagcttcgtttagcgagctaggtgcggcagaaccaagaagcttgccaaaattactcgtagatggtccctatggtgcccctgcgcaggattttagaaactacgacgttctacttctcgtcggcctcggaatcggggcaacaccgttcataagcattctacgggatctgcttaataacattaagatagctgacgagctgatggacttggcaatggagaccagcaggtctgaagacagcgccaacagctttagcgtctcaacggcgagtagcaaccggaagagagcatacagaacaagccgtgcacatttctactgggtcacccgagaagccggatcctttgaatggttcaaaggggtgatgaatgaggttgcagaaatggacaagaagggtatcatagagctgcacaattacctcactagcgtttacgaggaacgcgacgcacggacaactctgctgtccatggtccaggctctgaaccacgccaagcacggcgtcgatatcgtatcggggaccagggtgaggacgcatttcgccagacccaactggaaggaagtcttcaccaggatcgcctccaagcatccgaattcaacagttggtgtgttctactgcggcgcaccgacgcttgccaaggagctgaaggctctggcgcacgagatgagccacaggacgggcactcgcttccatttccacaaggagtacttc

SEQ ID NO: 5615 - DNA, 486 bp, Zea mays
atgtcagctggtctattatttggtaatgtgactggtacaattattgtttcagtcggtggaacgctagctgcagcggtggccttccttattgctagatactttgccagagagagaattcttaaattggttgaaggaaataagaagtttctggcaattgataaggcaataggtgaaaatgggtttaaggttgttactttgctacgcttgagtcccctgttacctttctcccttgggaactatctatatggccttacttcagtgaagttcttgccgtatgtcttgggcagttggttgggaatgcttccaggttcatgggcttacgtcagtgccggtgcattcgggcgagctttaatccaagatgagtcggaaattggtttgggaggaaacgaacagctatggacactgggcgttggattattgtttacagccattgctgccgcttatgtaacgaggctcgcaaaggacgctgtaaaggagatcgacgac

SEQ ID NO: 5616 - DNA, 714 bp, Zea mays
atggccgccgcgctcaggtgcccggcctccgtcagggtctcgggccccgccgccgcggggctcgccaaggtgcgccaggcgtccagagtcgtcgcggtgagcggggcccggcagagccgcggcggcggcgtcgccgtgcgggcgtcgctgttctcgcccaagcccgcggcggccaaggacgcgcggccgaccaaggtgcaggagctgtacgtgtacgagatcaacgagcgggaccgcgagagccccgcgtacctgcgcctcagcgccaagcagacggagaacgcgctgggcgacctcgtccccttcaccaacaaggtgtacaacggcagcctggacaagcggctgggcgtcaccgcgggcatctgcgtgctcatccagcacgtccccgaccgcaacggcgaccgctacgaggccatctacagcttctacttcggagactacggccacatctcggtgcagggcccgtacctgacctacgaggagtcgtacctggcggtcaccggcggctccggcgtcttcgagggcgtctacggccaggtcaagctcaaccagatcgtcttccccttcaagatcttctacaccttctacctccggggcatcccggacctgcccagggacctgctctgcacgcccgtcccgccgtcgcccaccgtcgagcccacccccgccgccagggccgccgagccgcacgcatccctcgacaactacaccaac

SEQ ID NO: 5617 - DNA, 639 bp, Zea mays
atgttctacgcgccggtgctgttcaacacgctggggttcaagagcgacgcgtcgctctactcggccgtcatcacgggcgccgtcaacgtcctctccacgctcgtctccgtctactccgtcgaccgcgtcggccgccggatgctgctgctggaggccggcgtgcagatgttcctgtcgcaggtggccatcgccatcgtgctgggcatcaaggtcaccgaccactccgacaacctgggccacggctgggccatcatggtcgtcgtcatggtctgcaccttcgtctcctccttcgcctggtcctgggggcccctgggctggctcatccccagcgagaccttcccgctggagaccaggtcggcggggcagagcgtcaccgtctgcgtcaacctgctcttcaccttcgtcatcgcgcaggccttcctctccatgctctgccacctcaagtacgccatcttcgtcttcttctccgcctgggtcctcgtcatgtcgctcttcgtcctcttcttcctgccggagaccaagaacgtgcccatcgaggagatgaccgagagggtgtggaagcagcactggttctggaagcgctacatggacgacgacaaccaccacatcgtcaacggcaagctcaccggcgcctccgtt

SEQ ID NO: 5618 - DNA, 543 bp, Zea mays
atggagcgcgaccgccggcgcaagctcaacgagaagctctacgcgctgcgcagcgtcgtgcccaacatcacaaagatggacaaggcgtcgatcatcaaggacgcgatcgagtacatcgagcagctacaggcggaggagcggcgggcgctgcaggcgctcgaggccggcgagggggcgcgctgcggcggccacgggcacggcgaggaggcgcgcgtggtcctgcagcagcccgccgccgccccggcgcccgtggaggtcctggagctgcgcgtgtcggaggtgggcgaccgcgtgctggtggtgaacgtgacgtgcagcaagggccgcgacgccatggcccgcgtgtgccgcgccgtcgaggagctccggctccgcgtcatcaccgccagcgtcacctccgtcgccggctgcctcatgcacaccatcttcgtcgaggtggattcggaccagacgaatcgtatccagatcaagcacatgatcgaggccgctctcgcccagctagatgatgcctccgcgagcccgccgagcgtgatgagctactat

SEQ ID NO: 5619 - DNA, 798 bp, Zea mays
atgaactggggcacgcaggccacgcacccgctgccgcccaagatcgtggcgcagctcctcagggacaacggcatcaagaaggtgaagctgttcgacgccgaccagggcacgctcagcgcgctcgccggcaccggcatcgaggtcatggtcgccatccccaacgtcatgctcgacaccatgacggactacgacaccgccaaggagtgggtgcgccggaacgtgtcccgctacaacttcgacggcggcgtcaccatcaagtacgtggccgtgggcaacgagccgttccttgcggcctacaacggcacgttcgacaaggtgacgttcccggcgctgcagaacatccagaacgcgctgaacgaggccgggctcggcgacaccgtgaaggccaccgtcccgctgaacgccgacgtgtacatgtccccgaaggacaacccggtgccgtcggcggggcggtggcgcgccgacatcgccgacctgatgacgcagatggtgcagttcctgagcaacaacagcgcgcccttcacggtgaacatctacccgttcatcagcctgttcctgaacgacgacttccccgtggacttcgccttcttcgacggcggcgccgcgccgctggtggacccgggcagcggcgtgtcgtacaccaacgtgttcgacgccaacttcgacacctggtgggcggcgctcagtcggtggggggacgggggacatgccgtcgtggtggggcgagggtcggctggcccaacgacggggacaagcacgccaccaacgcgtacgcgcagcggttctacaacggcctgc

SEQ ID NO: 5620 - DNA, 972 bp, Zea mays
atggcggacggcggaggagaaggaggacctcctgcggcgtcggcggcgctcaaggaccaggggaatgagcagttcaaggcggggagctacctcaaggctgccgcgctctacacgcaggccatcaagctcgaccccgacaacgccaccctctacagcaaccgagctgcagcattcctgcagttggttaagcttagcaaagcgcttgctgatgcagagacaacagtcaggctgaagccacaatgggagaagggtcatttcaggaaaggttgtgttttggaggcaatggagcgctatgaagaggcgatagctgcatttcagatagctttgcagcacaattcacaaaatacagaagtctcgagaaaaatcaagaggctatctcagttggccagggaaaagaagcgagcccttgatgtagagaacatgcgttcaaatgttgacattgcaaagaacttagaatcactgaagactgagttggctacaaagtatggagatgcagaaacagggcagagtgtcttttctttcattgttaatgtggtagaatcagcagtaaaggtttggcatgatacaggaaaagtagatccaagggtccattttcttctcgatgatcagaagaccgatactgaaaaatatgccccagtagttaacattgacaaggcatttgagtcccccaacactcatgctgagtgcttcacatatctgcggcaatacgcggagaattgttctgcgaaggctgcttgtatggtggcacctaagagcatcatctcctacccacaggtctggaaagggcaagggtcgaggaagtggaagcttgaccagagcgacgggttcttcgtgcaattcgaggcaccggcgctgaggaagatatggtttgtgccaagcacaaaagagaagggacggacattgtgcaggagccctgaggccttggacatcggcatccatgaagtgctcccccgtatattcaaggaggcagct

SEQ ID NO: 5621 - DNA, 582 bp, Zea mays
atggtgcacgtcaacttctaccgcaactatggtaagacgttcaagaaaccaaggcgtccttatgagaaggagcgtcttgatgctgaactgaagctggttggtgagtatgggctgaggtgcaagcgtgagctttggagggtccagtatgcactgagcaggatccgtaatgctgcaaggcacttgctcacccttgacgagaagaacccccgtcgtatctttgagggtgaggcacttcttcgccgcatgaaccgctatgggctgcttgctgagggtcagaacaagcttgattatgttcttgccctcaccgctgagaacttcctcgcaaggcggcttcaaacacttgtcttcaaggctggcatggccaagtccattcaccatgctcgtgtcttgatcaagcagcgtcacatcagggttggcaggcaaattgtcaacgtcccatcattcatggtgagggtggagtctgagaagcacattgacttttcactgtcaagcccattcggtggaggccccgcaggaagggtgaagagaaagaatcagaagaaggcaagcggtggcggggatgctggtgatgaggatgaggag

SEQ ID NO: 5622 - DNA, 1146 bp, Zea mays
atgccgcaaccgcggtgggtggtcatcccataccctcctccacaccatcccatggtggccgcgccgccgccaccttctctgcagtttgtgaagcattttacgccgccgtcctcggtaacaccgccgccgccgactggatccggcgggaacgggggcgaggataaccggaccatctgggtgggcgacctgcagtactggatggacgaaaactatcttcacagctgcttcggctctagcggcgaggtggtgaatattaaagtcattcgcaatagacactcgggagtttctgagggttatggttttatagagttttatactcacgtttcagcagagaaggcactgcagaatttttctggtcacgtaatgcctaatactgaccgggcttttaagttaaactgggcatcatatagtatgggagaaaaacgctcggaaatttcgtctgatcactcgatatttgttggcgatttggctgttgatgttactgatgcgatgttgctggaacttttttctaacaaataccgatcggtgaaaggagctaaagttattattgatgcaaacacaggccgttctagaggctacggctttgttaggtttggagatgataatgacaaaattcatgcaatgactgaaatgaatggtgtttactgttccacaagaccaattcgtgtaggaccagcgactcctagaagatctcaaggtgattctggcacttctccaccaaggcaatctcatgttgactctactaacaggacggtatatgttggtgggcttgaccccaatgttagcgaagatgaactgaggaaagcatttgcaaaatatggtgatcttgcctctgtcaaaattccttttgggaaacaatgtgggtttgttcaatttgtaaacagagttgatgctgaagaagcactgcatgggttgaatggatcaactattgggaagcaggcagttcgactttcctggggccgcagccctgcaagtaaacagtctaggggtgattctggccaccggcgcaatggcaactgcaacggcatgtactacgggacaccattctacggtggatatggctacgcctccccgattccgcacccaaacatgtacgccgcggcctacgaagcctacccgtactatgggaaccagcagctagtgagc

SEQ ID NO: 5623 - DNA, 612 bp, Zea mays
atgttccacgtgtaccagcccatgccgatgccatccacggcggcggcccccgcgaaggcgggcaagaaggagggcggcaaggaccggcacagcaaggtgaacgggcgcgggcggcgcgtgcggatgccgatcgtgtgcgcggcgcgcgtgttccagctgacccgcgagctggggctcaagtcggacgggcagaccatcgagtggctgctccgccaggccgagccctccatcgtggccgccacgggctccggcaccaccccggccgtcttcgtctcctcctccgcgccgtccacgtcctcctcctcccactcccactaccagcagcagcagcagcagcagcaggccaccgtcgtcgtcctgggcaagcgcccgcgcgaggagggcggcgacgccgcggcggcgtccgtgccggcgttctgggcggcggcgccgcggacgacggcagcagcggacgccagctggggcttctcgccgctggaggcccagcaggcggcggcggggtacgtgcccatggcacaggcgcagcagcagcagcaccaccaccaccacctcaacctgctcgccgcgctctccggtgccgcgaggcgcgccgaggcggcggaggagacccga

SEQ ID NO: 5624 - DNA, 900 bp, Zea mays
atgccggccttcgactacacgccgccgccgtacgacgggccgcgcgccgaggagatcttccggaagcgcgctcagttcctcagcccatccctttttcatttctacgatcgcccattgaacatagtcgaaggaaagatgcagtacctatttgatgaggatggccgtcgttacctggatgctttcggtggcattgcaacagtttgttgtgggcactgccatccagatgttgttgaagccatagtaaaccaggcaaagcggatccagcactccacagttctatatctcaatcatgcaattgcagattttgccgaggcattggcttccaaaatgcctggtgatctgaaggttgttttcttcacaaattcaggcacggaggcaaatgagcttgcactgatgattgcacggctttacactggttgcaatgacattatctctcttaggaatggataccatgggaatgctgctggaacaatgggtgctactgctcaatccaattggaaattcaatgttgttcagacgggagtacaccatgcgcttaatccagaccccttcagaggtgcttttggttctgacggggagaaatacgccagagatgttcaggaaatcatcgaatttggaactacagggagagttggtgggttcatttcggaagccatacagggggttggtggaatagtggaactggcaccaggatacttgcccgtggcatacagtatggtaaggaaagccggtgggctctgcatcgccgacgaagttcaggcaggagtcgcgagaactggaagccacttctggggattcgaagggcatggtgtcatcccggacatagtcaccatggccaagggtatcgggaatggcatacccataggagctgtagtaacgacgccagagatcgctcaggtg

SEQ ID NO: 5625 - DNA, 450 bp, Zea mays
atgggatcggcggcgggcaggccggcggcggggtgcgggatcccggctgctcccatggcggcggagtcggcgtccttggcctcgtcccgcggcacgatgtcgacgaggaagtcgaagacctcggtgcgcgcgacggcggcggcgatgtcggacttctgcagcgtgcggcgcttgttctcctcggcgtgtgcccagccgcggtgggtgagctcgaggatgaacatctcgcaggcgcgggagaagacgacgggcgcctcggcggcgatcatgcgcacgtcctcgtcggccttcatgatcttcttgatgcgggcgagcggcaggttgtggttcttgaagtcggtggtggcctcgatctcgcggtattgctccgcccagaatagctgctgctggtgcgccgccgcggcgccctgctgcgaggaggggggcgccggcggcaggggaggaggaggg

SEQ ID NO: 5626 - DNA, 393 bp, Zea mays
atggatactaagctctcccatgctgagctgacacaccctgatgagcttgatgaggagtttgacacgttcccttcctccagaccagctgaaattgtaagaatgcgctatgacaggctgaggagcgttggaggtcgtgtgcaggctgtggttggggacctggcgacacaaggcgagagagcccatgctttgctgagctggagggaccctcgggccaccgccatcttcattttcttatccctggtgatcgccgttgtgctgtacgtgacgccgttccaggttttgatggtcatagccatgctttacctgctgcgacatccccggttccgcagcaggatgccctcagtgcctttcaacttctacaggagactgcctgccaagtctgatatgctcctt

SEQ ID NO: 5627 - DNA, 765 bp, Zea mays
atggccgtggcgtcggcggcgacgctcgtggccgcgcagtgcgtggaggcggccgagtccatcggcgccgagcgggagcacctggaggccgtggtcgggtcggccgtcaacgtcaggacgcccggagacatcgtcaccgtcaccgctgctgcggccaccgcgttgagaggcgcggccacgctgaaggcgagggctctgaaggaggtgtggaacatcgcggccgtgatcccggtagagaagggcgcggtcggcggcggcggcggcggcggaggaggagggcacaaccagaagcacggcgcgtccaagcagcagcagcagcatcgcaagctggagagcaacggcagcagcgtcagcgacgtgtcgctggaggaggagaacaacttcctcggcatctgcagccaggagcttctcgctcgcggcaccgagctcctcaaacgcacacggaaaggcgctctgcactggaaggtcgtatcggtgtacatcaaccggatgggcctggtgatgctgaagatgaagagccggcatgtggcggggacgatcacgaagaagaagaaaagcgtggtgatcgacgtgtgcagggacgtgccggcgtgggccgggcggcacctgctggaggacggcgagcaccggcggtacttcggcctgcggaccgcggagcaccgggtgatcgagttcgagtgcggcagccagcgggagcacgagatgtggatcaagggcgtggcgcggctgctgagcatcgccggcgagcggaggcgcctggtggcg

SEQ ID NO: 5628 - DNA, 627 bp, Zea mays
atgaagcagatgtccagtgccaagtttgttgagtcagcggaggcgcacttccgcatgaatctcgaccccaagtacaatgaccagcagctccgggccacggtgaatttgcccaagggaacaggccagtcggtgaagattgcggttctcacacaaggtgagaagatagatgaagctagagctgccggagctgatatcgtaggtggagaagatttgattgaacaaataaaaggaggatttatggagtttgacaaattgattgcatcacctgatatgatgcctaaggttgcgggcttaggtaagattctaggaccaagaggactgatgcctaaccccaaagctggcactgtttcttcaaatattactcaggctatagaagagttcaagaaagggaaggttgaatacagggttgataaatcaggaattgttcatattccatttggcaaggttgactttccagaggaagatctcattgcaaacttcatgtctgttgttcgctctgttgagaggaacaagccatctggtgctaaggggatatactggaaaacggcgtacttgtgctcatccatgggaccttctatcaagctaaacataaaagaaatgcttgactatggtttggaatcatctgac

SEQ ID NO: 5629 - DNA, 198 bp, Zea mays
atgagatccaagacgggcgcagcggggtgccgcccagcgacttccccaagtggctgccggccacccagcggaggctcctgcagcagacccagaagcctaacacggtggtcgcccaggacgggagcggcgacttcaagaccatcaccgaggccatcaccgccgtgcccaacaccttcgaggggcgcttcgtcatctacg

SEQ ID NO: 5630 - DNA, 273 bp, Zea mays
atggggtggaacggcatgccgggcagcgggagccccgggatggcgggcatgccgccggcgccgggggtcgggaacagcgggaacgacggcaaggtcgacggcggcagccaccacctcatgctgtggctgccggcggcggcggcggcgttccgggacgtcaaaggctccgtggtcggccccgcggcggcagtgacggtgacggtggtcgcggcggggacggccgtcgcgcggccgagctctggctcgaactccacgtggctggtatcgttctcg

SEQ ID NO: 5631 - DNA, 1134 bp, Zea mays
atgggcgctctgttccacgcgctgcccgcgcacgtcgagcagctgctccgccgcgtcgtcgtcgaacccagagccacgttcctcgtcgccgacaccttcttcgtgtggcccgccactctggccaggcgcctcggcatcgcgtatgtgtcgttctggaccgagccggcgctcatcttcaacctctactaccacatcgacttgctcacccagaacggacactttagatgcaacgagcctcgcaaggacacgatcacctacatcccgggcgtggcggccatcgagccgagcgagctcatgtcgtacctgcaggagacggacaccacctccatcgtccaccgcatcatcttcaaggcgttcgacgaggcccgcggcgccgactacgtgctctgcaacaccgtggaggagctggagccgtcgaccatcgcggcgctgcgcgcctacaggcccttctacgccgtggggcccatcctcccggcgggcttcgcgcgcagcgccgtggccacgtccatgtgggcggagtccgactgctcccggtggctggacgcgcagccggtcgggtccgtgctctacatctccttcggcagctacgcgcacgtgaccaagcaggagctgcgcgagatcgcgggcggcgtgctggccagcggcgcccggttcctgtgggtgatgcgcccggacatcgtgagctccgacgacccggacccgctgcccgaggggttcgccgaggccgcggcggggcgcggcctggtggtccagtggtgctgccaggtggaggtgctctcccacgccgccgtcggcgccttcctcacgcactgcggctggaactccgtcctcgagagcgtgtgggcgggcgtgcccatgctgtgcttcccgctgctcacggaccagctcaccaaccgccgcctcgtcgcgcgggagtggcgtgccggcgtgtccgtcggagaccgcggcgcggtgcgcgccgacgaggtgagggcgcggattgaagcggtcatgggcggggaagacggcctcaagctcagggagcaggtgaagaagctcaggggcacactcgaggctgccgtggcgtccggtggttcgtcgcggcacaacttcgacgagttcgtcgaggagctgaagcgccggtgcggaggccgc

SEQ ID NO: 5632 - DNA, 993 bp, Zea mays
atgggttcccgctacgaggtggaggtcaccgtcggctccgcccgggacctcaagaacgtcaactggcgcaacggcgacctcaagccctacgccgtggtgtggatcgactccggcagcaagtgctcgacccgcgtcgacctcgacaacggcgagagcccggcgtgggacgagaagctgctcgtcccgctcccgcccacctcccgcctcgacgacgccgtcctctacgtcgacgtcgtccacgccaacgccgcccagggcgtcaagccgctcgtcggctccgcgcgcctcccgctccgcgacgtcctcgacgacgccggggtcgggggcaaggcctcgcgcagcctccgcctcaagcgcccctcgggccgcccccacggccgcctcgacgtccgcgtcgccgtcaaggagccgtccaggtactacgaccccaacccctacccggcccccgcggcctacgccaacacgggcggcggcacccgtgacccctacggctcgtccgctgctgctgccggcggctactacggctccggaggcggatacggttccggtggtggcgcctacggtggcggcgcctacggcgccgcgcagccttacaccgcagcgcccccggcggggtacccttccacctacggcgccgcgccgccgcctcagccagcggcagcgtacggcgctcctcctgccgctgcatacggcgctcctcctgtcgccgccaccgccgcgtacggaaccggcgccgttgcttccgacgggaagaagaagaacaagatggggatggggacggggctggcagtgggcgcggcggcgggcgtgctcggagggctggcgctggccggcggggcgagctacctggaggacaagttcgaggagcgcgtgtcggagcgggtggaggacaacctggagagggaggagtcgtacggcggcggcggcggcggctacgggggtggctacgacgactatggcggcaacgacgactatggcggcgacgacgactac

SEQ ID NO: 5633 - DNA, 975 bp, Zea mays
atgcagcaggcgcagtcccatccgcagcagctgtcgcagcaggccatgtcccgcttcccctccaacatcgacgctcacctccgccctctagggccgcttcgcttccaacagccccagccccagccccagccgtcccactcccagggtccatctcagtcgccgtcgcaggccacgcagcaggcgtcaccccagcagcagcagcagcaggcggcggcggcggcggcagcggcgcaggcacaagcacaggcccaggcccaggcggcacgggtacgaagccccgagatggagatggcgctgcaggacgccatgcgggtctgcaatccggacgtcaagacgcccttccagtccatcgaggacgctgtcaacaggttattaccttaccatgttgttgccgactatgaggctgaagaagatgacaggatccttgatagcgacacaacaggccagatcccttctcgcctgcagcaatgggaccataatattctggtgaagattgctgagttcacgacaacttttgacaagcaagtattggcatataacataatgaccaagaaaagggccatcggtgagttcaggtcggaggagcggctcatgctggagcaagccttattgcaggaggaaaagcaagctatgctgggactgagggcagagatggagtcgagagagaaagctggtcgcgaggctgccgaagtgaagatgcgtttggcaatggagcatgctcgtgctgaggcacaagctcactctgagatgatgaatcatggtcctataagggccagtgctgttgcttcgcaaggggaggatggtccgagtcatgacatggtgcaagaacatggcgaagatgggtggggaaattctcagagggatgatgaagatccatcggaggatttcctcaacgatgagaacgaacctgagaatgggaactcagatgggcaggaggactggcgcagatctggggagtttgatctcaactctagg

SEQ ID NO: 5634 - DNA, 333 bp, Zea mays
atgacgacctccgcgccgacccggcgtaccagagctactactactccaatgcgcacctcaacccccgcctcccgccgccgctcctgtccaaggaggactggcgctcctcgcaccaccgcctccgctccgcggccttcggcgggatcggggacggcaggaggcagcagcagccggctgcccaagggacggtcggcctgcccgggatcgatcttgcccgccagaggagcttctccaccgtctttcaggaggattcgtatcagcgtgatatggataggcagactgccagccacaatagtagtgaatcattatgttcttctggaatacagtatggtc

SEQ ID NO: 5635 - DNA, 549 bp, Zea mays
atgaacacgttgatatcatttctgtggtggatcattggattctactggatattctcaggtggggaggtgctcgagcacggcgctccaaggctgtattggttaaccattgtgtttctggccttcgatgtgttttttgctgtgttttgtgttgctgtggcctgtttcattgggattgcactgtgttgctgcttgccttgtgtcattgctattctgtatgctctggctggccaggagggtgcatcagatgcagatattagtgttcttctgagatatagatattctgatccaagcgaagatggtgagaagggggtcgatgaaggactgatgatccctatcctgaataatagtggaatgtcaacaagtgagcgtattctccttcgcgaggatgctgaatgctgtatctgtctatcatcatatgaagatggagctgagttatctgctctcccctgcaatcatcacttccactggccttgtattaccaaatggctgcgcatgaatgcgacgtgtccactctgcaagtataacattctcaaaggcagtgacagtgca

SEQ ID NO: 5636 - DNA, 525 bp, Zea mays
atggcgagttcccggaggagctccgggctctcctccggtgccgcagcgctgggcattgcgctgctggtcctggccgccagcgcgggcaacgccggcgcgtcgtactacggggagatgaggcggcagttcctggcgcagcagaacgcggcgcgcgcgtcgctgggcctggcgccgctggcgtgggacgagcgcgtggcggcgtacgcgcgggcgtacgcggagtcgcggcgcggggactgcgcgctggcgcactcggcggggccctacggcgagaacctcttctggggcagcggcaccggctgggcgcccgcgcaggccgtcgccgcctggctctccgagcgcccccgctacgactactggaccaacagctgctacggcggctccatgtgcggccactacacccagatcatgtggcggagcacccgacgcgtcggatgcgccatggtcgcttgctacggcggcaggggcaccttcatcacctgcaactacgacccgccgggcaactacgtcggcctgcgcccgtac

SEQ ID NO: 5637 - DNA, 285 bp, Zea mays
atgccgggcgccgacgtcgaccaggacgagccggaaacggcggcgcagctgatcatcgtgtacggagggcgggcgctggtgctcgacgacgtcgcggcggacaaggcggcggacctgctgcgcctcgccgcggcggcggcggcgcgaggaggcacagagcagccgctctgctcgctcgccgacctaccccgtggcccggaaggcgtcgctgcagcggttcatggagaagcgcaaggacagggtcgccgcccgcgcggagccgtaccgccggcgccgacccgtcgg

SEQ ID NO: 5638 - DNA, 384 bp, Zea mays
atgttgtgtatggtggagctgctgcggcggcagcagcgggcatgtggtggtggtggagggcggctgcggcggggagcgggaagttggtcctggccttgggcccgcgcagcatccgcgctgcggcgtcgtaggcacgggcggcgtcctcggcggagtcgaatgtgccgagccagacgcgcgccttcttcgccgggtcccggatctccgctgcgtaccggccccacggcctcttccgcaccccgcggaaccgcaactccacgtcaccgtccgcctcagccgccgccacgccgcggcgccgcatgccgccggatcagcggagcgcgagggtgcgggaacgaacggggatcggagaattggtattggaagcgagtatttgggaatccg

SEQ ID NO: 5639 - DNA, 441 bp, Zea mays
atgatctacgcgcagtggaagtcgttggggcagttcttgccgcagttgttgaggatgaggctgaggtcgatggggaggttaaggttgatgccgaggatgttggccttgacggcggtgcagaggcagacggcggcctccaggtcgacgagcccgtccagcagcgagcagcacggctcgtacggcggcgagcctaccttggccttcaccaggcccagcacgttggcgcacacgcccagcttcagcgcgttcctggggcacgacccgtggccgtggtggccgccgggcgtcggcggctttggggccggcggcagcggtggcggtgggcagtcggtcgcgctcgcgctcgccacggcggcaaggataaccaggctgacagccagctggaggagcgccgctctcgcagccatggtcgaacgagtgagctgcttgcacttgcacacg

SEQ ID NO: 5640 - DNA, 1029 bp, Zea mays
atgagggggcagacagagacaggccggtggcgaggaggcgacggcgttgcggcgtggtgggtggccgtggtggccctgcagctgggccattcgctgagccgcgcgcgggcggggctgctggagtccaacccgggccttgcctacaacttctaccagagcagctgccccagcgcggagtccatcgtccgcagcgtcacctgggcgcaggtcgccgccgaccccgcgctcccggcccgcctcctccgcctccacttccatgactgcttcgtcaagggctgcgacgcgtcgatcctgctggacaacgcgcagagcgagaagacggcggcgccgaacctgtcggtgggcgggtacgaggcgatcgacgcgatcaaggcgcaggtggagaaggcgtgcccgggggtggtgtcgtgcgcggacatcgtggcgctggcggcgcgcgacgcggtgtcgtaccagttcggggcgtcgctgtggcagtggagacgggccggcgggacggcggggcccccgtcgctggcgtccgacgcgttgggggcgctaccgtcgcccttcgcagggttcggcggcctgctggcgggcttcgccagtcgcgggctcaacctgacggacctggtggcgctgtcgggggcgcacaccatcggcgtggccagctgctccagcgtcaccccgcgcctgtaccaggggaacgccaccagcgtcgacccgctgctggactccgcctacgcccgcgcgctcatgtcgtcgtgccccaacccgtcgcctgcgtccgccaccgtgggcctggacggcggctcgccggccaggttcgacagcgggttctacgcccgggtgcgccagggccagggcacgctggcctccgacgccgcgctggcgcagaacgccgccgccgcgcagctcatggccgacctctccacccccgccagcttttacgccgccttttccatgtccatgaagaagatgggccgcgtcgacgtgctcaccggcaccaacggccagatcaggaagcagtgccgccagatcaacacatct

SEQ ID NO: 5641 - DNA, 594 bp, Zea mays
atggcggcggcggcagcaggcaacggaggaggcggcacctcggccggccaagacagctgcgtcaccgcggcgccagctggccgcggcgcgcgtagcaagcggtcctcccgcgcgcccgcggcggcggcgtggcactccctcgtgtcgcgcccaccgtcgcagccgtcgccatcctcgtcgtcctgctcgtcttcggacttcccgtcgtcgtccaacaggccagcgcgcggcaggaagagcccggggcccggcggggacgcggtggcgggctcggacggcggcgtgcggcggtgcacgcactgcgcgtcggagaagacgccgcagtggaggacggggccgctgggccccaagaccctgtgcaacgcgtgcggcgtgcgcttcaagtccgggcggctcgtgcccgagtaccgccctgcggccagccccaccttcgtgctcacgcagcactccaactcgcaccgcaaggtcatggagctgcgccgccagaaggagctcatcctcatccgcggaagccaccgcgacgccgccgcggctgcaggagcaggatccgccgggccgaggccggagctcatgttccgcgactacggcgtgtgt

SEQ ID NO: 5642 - DNA, 525 bp, Zea mays
atggaggcgatggcgcaggtgaaggagatgatctaccgcgcggcggccatgcggcccgtgaacctcgggcccgaggccgtcggcgcggcgggggcgggcgcggagaggccccggcggaagaacgtgcgcatctcgagcgacccgcagacggtggcggcgcggctgcggcgcgagcgcgtgagcgagcgcctgcgcgtgctgcagaagctggtcccggggggcagcaagatggacacggcgtccatgctcgacgaggcggccagctacctcaagttcctcaagtcccaggtccaggcgctggaaaccctaggcacgacgacggcgaccaacgccaacagcagcgcgagcgccaccaccagcaggagcagcgcggcgagcaggtcgccgcagtacaactattacggcggcggcggcaataataataatcctgccggctttcttggattcagtaacgttatttctccggctgggtatgtaaatccgggtggatcgtcgtcgaatactggcagcaacaaactgctgttt

SEQ ID NO: 5643 - DNA, 648 bp, Zea mays
atggatctgttggagcggaatattaagacggagacggaggagacgcgcaaggaacaggagcgtaaggaggaggaggcggaggcggaggcggaggcgggggagaggaagacccaggagccgccgcagcaaggccagggcctcagcctctcactcgccaacggcagtggcaggtctggaatgttgccgatgtcgaacgtgtccgctaatccttcacagcttacaattttctatggcggatcagtatgtgtgtatgactcagtgccaccggaaaaggctcaagcaatcatgcttatagctgcagctgcagcggcagcggcagctaccaaaagcagtgctgcccctactgttaagcctccaatggtgcctgcagccactgttgccccagcagctgtcgtttctcctgtgcttacacggtctccatcactgcagagcacttctgtagcaactgggcaacctcaggttgttgctgaacctagctcgatatgcaaacttcaggctgatctccccattgccaggaggcactctcttcagcgtttccttgagaaacgccgtgacagggtcgtgagcaaagctccatacagcaccgccaagtcgtccgatggcatggagtcaccgaggattgaggtgacagcggagggcaaggcccag

SEQ ID NO: 5644 - DNA, 678 bp, Zea mays
atggggcttgactattacaagatcctaggcgtcgacaagggcgccaccgatgacgacctcaagaaggcctaccgcaagctcgccatgaaatggcaccccgacaagaaccccaacaacaagaaggaggccgagaacaagttcaagcagatctcggaggcgtacgaggtgctgagcgacccgcagaagcgcgcggtgtacgaccagtacggcgaggagggtcttaaggggcaggtgccgccgccgggcgccggcggggcggggcccggcggcgcaaccttcttctccaccggcggcgacgggccgacggtgttccggttcaacccgcgcaacgcggaggacatcttcgccgagttcttcggcggctccagccccttcggcggcatgggcggcggtggcatgggcggcagcggcatgggcggtgggatgcccggcatgcggagcggcggtacgaggttctcctcctccatcttcggggacgacatattcggctctgcgttcggcggcggcccggacgggcacggcatgcacgccggcgggcgggccgtgaaggcgccggccatagagcggaagctgccgtgcagcctcgaggagctgtacaagggcaccaccaagaagatgaagatctccagggaaatctctgacccccagtgggaagacgatccccagtggaagagatcc

SEQ ID NO: 5645 - DNA, 1473 bp, Zea mays
atgcggcgcggggtgccggcccccgcggagctcacggccaacgtgctgggccacccgaccccgagcctccgcgaccactacgcgctcggccgcaagctggggcaggggcagttcggcaccacctacctctgcacggacctcgccacgggcgtggactacgcctgcaagagtatagccaagcggaagctcatcaccaaggaggatgtcgaggacgtgcgccgcgagatccagattatgcaccacctggctggccaccggaacgtcgtcgccatcaagggcgcgtacgaggaccagctgtacgtccacatcgttatggagttctgcgcgggcggggagctcttcgaccgtatcatacagcgggggcattacagcgagcgcaaggccgcggagctcacgcgcattatcgttggggtcgtcgaggcttgccactcgctcggggtaatgcacagggatctcaagccagagaacttcctgctctcgaacaaggatgacgatatgtcgctcaaggccatcgacttcggcctctccgtgttcttcaagcctggtcaaatttttaccgatgttgtgggaagcccttactatgtagctccagaagtgctgcgcaaacgatatggaccagaagctgatgtgtggacagctggagttattctttacatacttctatgtggtgtaccgccattttgggcagagacacagcaaggaattttcgatgctgttctgaaaggtgtaattgattttgatttggatccctggcctgtgatctctgagagtgcgaaggatcttataaggagaatgctgaatcctatcccatcagagcgcctaacagcacatgaagttctatgtcatccatggatttgtgaccatggagttgctcctgatcgtcctcttgatccagctgtcctgtcacgcatcaagcagttctcagcgatgaacaagttaaagaagatggctttgcaggtaattgctgagagcctttcggaggaggagattgcagggctgaaggaaatgttcatggcaatggatacagataatagcggtgcaattacatatgatgaactgaaggaaggattgagaaagtatggctccacattaaaggatactgaaattcgtgatctcatggaggcggcggatatagacaacagtgggaccattgattatatagaattcattgctgctacattgcacctcaataaactggaacgtgaggaacatctagttgcagcattttcgtattttgacaaagatggcagtggttacattactgtggatgagcttcaacaagcgtgcaaagagcataacatgccagctgcttttcttgatgatgtgattaaagaagctgaccaggataatgatgggcgcattgattacggggaatttgttgccatgatgacaaagggcaatatgggagttgggaggagaacgatgagaaacagcttgaacataagcatgagggatacgcctgctggtgccctc

SEQ ID NO: 5646 - DNA, 654 bp, Zea mays
atggctggacacgcgccggcgagggacaagaccaccaccggcttcgccgctacgtgcagcctgctgagccagtttctcaaggagaagaagggcggcctgcagggcctcggcggcctcgccatggcgccggcgccggcagctggagcaggggctttccggccgccgaccaccatgaacttgctgtccgcgctcgacgcggccaaggccaccgtcggggagccagaaggccatggccaacgcaccggcgggaatccaagggaggcagctggggaggaggcgcagcagctgaccatcttctacggcgggaaagtggtcgtcttcgacaggttcccctccgccaaggtcaaggacctgctgcagatcgtgagcccgccgggggccgacgccgtggtggacggtgccggtgccggtgccgctgtccctacgcagaacctgcctaggccttcacacgacagtctctctgccgatctgccgatcgcgaggcggaactcgctgcacaggttcctcgagaagagaaaggacaggataaccgcaaaggcgccgtaccaagtcaacagttccgtcggcgctgaggcgtccaaggcggagaaaccctggctgggtctgggccaggaacaggaaggaagcgacggtcgtcaagcaggagaggagatg

SEQ ID NO: 5647 - DNA, 741 bp, Zea mays
atggcggcggcggcggcgacggcgaccacgacctctccggcgagggcttcgtggcggcctacggttcccgcgacctcggcatcggcagcaggagtctgcttccgtgttggagcgaagcgcttcagtccagggctccgaacggcaagcacctgtcggcaccgacaccgaggcagaacaaggctcacaacagctcacgtcaagagcggggaagccgaggggcgtccaagcacggaggagagcgcaactggcatcggcggcccggacgaggactccttgcggcgcgagctcgaaaccgcgatcgaggaggaggactacgcgcgcgccgcggcgctccgggacgagctgcgcgtgctccaggaggactgccgggccgcggtgctggcggcgaacgcgcggttctacgccgcgttcaaggacggcgacctggcggcgatgcgccgggcctgggccaggggcgaccacgtctacgtggtgcacccgtcggcggggaggatctccgggtacgagatggtgatgcagagctgggagatggtgtgcgacgccggctacgagttcccgctgcaggtggacctgcaggacgtggaggtgcgcgtgcggggcggcgtcggctacgtcacctgcctggagatggtcaggaccaaggggagcagcagctggggcaagcagctggccaccaatgtgttcgaggaggtggacggcgagtggctcatgtgcgtccaccatgcctcgcacttcgatgag

SEQ ID NO: 5648 - DNA, 441 bp, Zea mays
atgcctgcctcgccgcctaatcggatcgcccaacaacagtcacctagagcgggcttggcttattaccaggcgctggtctccctgtccctccgcggcgggatctgcgacggcgacagcggcgactcctcgctggcgctgctccgcgagtccccgcgccagtcgtcctgcacctgcgccgcgaactgcaggttccacagcacgtcctccaccgacggccgctgctccgcctccttggccaggcagcgcaggcagatctccatcaccgtccgcgccgactcgtcggagcacgcccggctcaccgcctggtccaccagcgccctccgccgccccgggctctccgacgtcagcgccgactgcagctgctccttcatgacctccacctcgtgtatggacgtgatgggcctcccggtcacgacctcgagcaggatcacgccgaaatcg

SEQ ID NO: 5649 - DNA, 453 bp, Zea mays
atgcgccgaagggcgaatccggagcgccgctttgcgggcgacggggacgacggcgcggagctggactcgctgcggggcgacgtgacgacggacagcgccgccggccgccgcagcatggtcaagctccgcgtcacggcgcccggaggcggcgcggagcccgccgccgccgccgccgccaccgccgccgacgacgacgacgagggggagaaggaggcgtacttgcggagcttgccgaggccggagtccgggcgcggcccggccaccgtgtcgtcccacagctggttcaggagccccatatatgcaccggtgcgtgcgcgtcctacgtacgtgcgaagtggccggccggcgacggcgtggtgcgcgttttgcttcgagagcgatgctcttgctctgtttcctttggttctcttgtttgatgttttcgttgtccttggggcgagaggaagagaggcg

SEQ ID NO: 5650 - DNA, 963 bp, Zea mays
atgtcatttgctaagctgaacgttcttcattggcatatcatcgatgagcaatcctttccattggaggtgccaacatatccaaacctttggaaaggttcatactccaaatgggagcgctacaccgtggaagatgcacatgatattgtcaactacgctaagaaaagaggtatcaatgtgatggcagaaattgacgtgcctggtcatgcagaatcatggggaaatggatacccaaagctctggccttctcccatttgtacagagccattagatgtctctagtgatttcacatttgaagtaatttttggaattttgtctgatatgaggaaaatctttccattcgggctgtttcacttgggtggtgatgaagtatacacagggtgctggaacacaacgcctcacgtgcggcagtggatggacgagcgcaaaatgaccacgaaggacgcttacaaatacttcgttctgaaggcccaggagctggcgatcaagctgaactggactcccgtgaactgggaagaaaccttcaactcgttcgaagaaaacctcaatccactgacggttgtgcacaactggctggggcccggagtctgcccaaaggttgtggccaagggtttcagatgcataatgagcaaccaaggcgtctggtacctggaccacctcgacgtcccctgggaggacgtctacagcggcagagcgtctgtggagccagctggaggccatatccgcccaggacgtcgagacgaccgtgctgtcacggctacaccgcttcaggtgcctgctgaaccaccgtggggtcgccgcggctcctgtcacgaactactacgctcggaggccgccggtcggcccgggttcgtgcttcgttcagtaaagcaagcagccaagcaggaaggtaccctcctacccacgccacgaggtgctctgccttcgtgtaccatatctgtgtgtaatccacggaaacaatctgta

SEQ ID NO: 5651 - DNA, 609 bp, Zea mays
atgagtctccctcgccgccgccaccttgtcctgctcgcctgcctcctggtcttcctcgtcttcgccgcgtccgcgtcgacgagttccgccgaggtggccccgagcgtggcggtggacttcgtgcggcggtcgtgccggtcgacggagtacccgcgcgtgtgcgagagcacgctggtcccctgcgcggctggcgtggggcgcagcccgcgcctgctggcgcgagcggcgctggtggttggcgccgaccgcgcgcgcaactgctcctcctacatccgcggcggcggcggcggcgcgatgaaggactgcgcggagctggcgcgcgacgcggaggagcggctgcggcagtccgcggcagagatggagcggatgggccgtgccggcacaccgcgcttcgcttggtccctcagcaacgtccagacctgggccagcgccgcgctcaccgacacctccacctgcctcgactccctcgcccagcagtcccgcggtggcaaggacagcgacgacgccgtcagggtgaagaggagggtggtggccgtcgcgcaggccaccagcaacgcgctcgggctcgtcaacaggctccagccggcgccgcaccggcggcgtctcctg

SEQ ID NO: 5652 - DNA, 1194 bp, Zea mays
atggcgctttataatgggcgggatttgtgtttcagaaatatacgtttttcctcggggagaacttgcttaattttggttgctgattttttgccagatgggcgatatgttagcatgatagataatccagatcagaggtttgcagctttcctatctccgcttacacttggtcgagtaaacattgcagttaactcagtctacatttcaaaggtcagcctagcaattgctgtgagatacagtttgtcaaggagagccttttcaattgcaccagatgcccctgaaatgttgttgcttgactatcccagtcaccagcgacgccttctaccacttctagcaaaagtatgtctgatgagcagtgctggcaattttatgaaaaatatgtatgtaaagagaactcctgaaatgagcaaagacatacacatttactctagtgctctgaaggcgacactaacttggcagaatatgattacgattcaggagtgtcgcgaggcctgtggaggtcaaggtctaaagactgagaaccgcataggaattttcaaatctgaatttgatgtccagtccacatttgagggtgataacaatgtgctaatgcagcaggtaagcaaagcgctttatgctgaatttttgggtgcacaaaagaagcagcagccattcaagggattgggtttggaacacttaaatggctcgagccctgttattcctgataagctgacaagtagcatattaaggagctccaagttccagatggacctgttctgcttaagggagagagatttactgaagcagtttgtagaggaggtttctctccatcttgcacaaggcgaaagcagagaaaaggctttgatgctgagttatcaagttgctgaagacttggctagagcgtttactgagcgtacgatcctccaaatatttttggaggatgagatgaatgttccttctggttccctaaaggaggtactgggcttgctgagatctctatatgtcatggtgaacatagatgaatccacatcttttctaagatacgggcatttatcacgtgacaatgtagcccttgtgcggaaagaagtcctgaaactgtgcagtgaactcaggccccatgcgcttgctgttgttagttctttcggaatccctgatgccttccttagtccacttgcttttgactggattgaggcaaatgcactgtcaaccgggagccac

SEQ ID NO: 5653 - DNA, 1071 bp, Zea mays
atggactccatggccagcgacgacagcaaccaaggagcagcagccaagccgaagccgaagccaccaccgctaccgctgtccgtgcgcctccagctggccgggctgacagcggccatcgacgccgtggagcgccgcgacgggacggtgaaccgctgcctgtacggcgtgatcgaccggctcctgagcgcgcgcgccagcccgcgcccggacgcctccggggtgcgctcctacgacgtgaccatggacgcgtcccgcggcatctgggcgcgcgtcttcgcgccggccgcggcggaccgcccgctccccgtggtggtgtacttccacggcggcggcttcgcgctcttctccccggccatcgggcccttcaacggcgtgtgccgccgcctctgcgccgcgctcggcgccgtcgtggtgtccgtcaactaccgcctggccccggagcaccgctggcccgccgcctacgacgacggcgtcgacgcgctgcgcttcctcgacgcccgcggcggcgtcccgggcctggacgacggcgtgcccgtcgacctcggcacctgcttcctggccggggagagcgcgggcggaaacatcgtgcaccacgtcgccaaccgctgggcggcggcgtggcagccgtccgcgcgggccctccgcgtcgcgggcgtcttccccgtgcagccctacttcggcggcgtggagcgcacgccgtcggagctggagctagagggcgtggcgcccgtggtcaacctcaggcgctccgacttctcgtggaccgcgttcctgcccgacggcgccacccgcgaccacccggccgcgcacgtcaccgacgacaacgccgacctcgccgacgacttcccgcccgccatggtcattatcggcggcttcgacccgctcatggactggcagcgacgctacgccgacgtgctgcgccggaaggggaaggaggtgctggtggccgagtacccaggcatgttccacggcttctacggcttcccggagctccccgaggctaccaaggtgctgcaggatatgaaggccttcgtcgacagccacatacccacgcccaagctcgccgacgcg

SEQ ID NO: 5654 - DNA, 309 bp, Zea mays
atgtccgggcgcggtaagggtggcaaggggctcggcaagggcggcgcgaagcgtcaccggaaggtgctgcgcgacaacatccagggcatcaccaagccggcgatccggcggctggcgaggaggggcggcgtcaagcgcatctcggggctcatctacgaggagacccgcggcgtgctcaagatcttcctcgagaacgtcatccgcgacgccgtcacctacactgagcacgcccgccgcaagaccgtcaccgccatggacgtcgtctacgcgctcaagcgccagggccgcaccctctacggcttcggcggc

SEQ ID NO: 5655 - DNA, 333 bp, Zea mays
atggcgttgcggaatgggaagcacagtgcggcgcccgctggcttccttgcactgccgcggctcggagacggcgcggcgaccggaagcgccggcttggcattggtgactggtcaccggcgcgtcaggctcctgcggcggcgccgggaaccgcgtggagaggtcgaaatcgacgagcatgatgtggccgctgtcctggatgaggacgttctccggcttgaggtcccggtacacgatgccgaggctgtgcaggtactcgagcgccagcaccagctccgcggcgaagaaccgtatgacggagtcggagaacatcttctcggtctgccgccgccgcag

SEQ ID NO: 5656 - DNA, 693 bp, Zea mays
atggtattgagcaggagtacaccctcctccagaaggacaccaactggccccttgggtggcccatcggtggcttccccggccctcaggggtccttactactgtggaatcggcgccgaaaagtcgttcggccgcgacatcgtggacgcccactacaaggcctgcttgtatgcgggcatcaacatcagtggcatcaacggggaggtgatgccagggcagtgggagttccaagtcgggccttccgtgggtatttcttcaggcgaccaggtctgggtcgctcgctacattcttgagaggatcacggagatcgccggtgtggtggtgacgttcgacccgaagccgatcccgggcgactggaacggcgccggcgcgcacaccaactacagcacggagtcgatgaggaaggagggcgggtacgaggtgatcaaggcggccatcgagaagctgaagctgcggcacagggagcacatcgcggcctacggcgagggcaacgagcgccggctcaccggcaggcacgagaccgccgacatcaacacgttcagctggggcgtggccaaccgcggcgcgtcggtgcgcgtgggccgggagacggagcagaacggcaagggctacttcgaggaccgccgcccggcgtccaacatggacccctacgtggtcacctccatgatcgccgagaccaccatcatctggaagccc

SEQ ID NO: 5657 - DNA, 429 bp, Zea mays
atgaccctcggtgctaaagtcataaggaaattggcagatgaggtgttctcaattgttggacgggatccacttattgaggtggccattgccctagaaaaggcagcgctgtcagacgaatattttatcaagaggaagctgtatccaaatgtggatttctactctgggctaatttatagggcaatgggattccctacagaattttttcctgtgctgtttgctattcctcgcatgggtggctggctagcgcattggaaagagtcactcgatgatcctgacactaagattataaggccccaacaggtatacaccggcttctggcttaggcactatacccccgtcagagaacgagtgctatcaagccagagtgaggaacttggtcaggttgccacctcaaacgcaactaggcgccgccgtgctggttctgccctg

SEQ ID NO: 5658 - DNA, 720 bp, Zea mays
atggtccaagatcgcggcgcacctgccaggcaggacggacaacgagatcaagaactactggcggacgcgggtgcagaagcacgccaagcagctcaactgcgacgtgaacagcaagcgcttcaaggacgccatgcgcttcctctggatgccacgcctagccgagcgcgccgcaacagccgcccaccagccgcagccgcagcacgtcgctgccgcctgcaacaacgtgctggtggcggcggcggcggcggccaacagcagcagctgctgctggtcctccccacgcagcagcgccgtcaccacggccgcctgcagcggcagctcctcctgcagctcgctcacgtccgagtccgcgcacaacgacgacgatggcgcccggccgcacgccaccgccgtgctggcggcggcggcggcggcgacgggcgacgacgactactggggcgctgtcacgacgactatgcagcaaaatcatcatcagcagcagcagcagaacgagcagttcgacttctggtccacggcgtccgcgctgcagcacctgactaccgccgccgccgaccaggacctcaccggctgggtgcagggcttctccgacgacggcatcctgtccggctcctcgtcggacagcctctggagcctcgacgacatctggaggatgcagtgacagtgagacgtatagtacggcgcgctgttgtctgtcgtttacgtcaatttttgcccgcgtgt

SEQ ID NO: 5659 - DNA, 1287 bp, Zea mays
atggcgggcgccgtgtcggcgctcttcctgctggacattaagggccgcgtcctcgtctggcgcgactatcgtggtgatgtctccgcgctccaggccgagcgcttcttcaccaagctcctcgacaaggagggcgactcggaagtccactcgcctgtggtctacgacgacgccggcgtcacgtacatgttcatccagcacaacaatgtcttcctcctcaccgctgctcgccagaactgcaacgcggccagcatcctcctcttcctccaccgtgtcgtagatgtgtttaagcactacttcgaggaactggaagaggagtcgctcagagataacttcgtcgttgtgtatgagttgctggatgagatgatggatttcgggtacccacaatacacggaggcgaagatcctaagtgagttcatcaagacagatgcgtacaggatggaggtcacacagcgtccacccatggccgtgacaaatgctgtgtcatggaggagcgaggggatccgttacaagaagaatgaagtcttcttggatgtagtagagagtgttaacattctagttaacagcaatgggcagattgtgagatcagatgtggttggggcactgaagatgcgaacatatttgagtggaatgcctgagtgcaaactcggcttgaatgatagggttcttttggaggctcaaggcagagcaactaaaggaaaagcgatagaccttgatgatatcaaatttcatcagtgtgtacgtttagctagattcgagaatgatagaactatatcgttcatacctcctgatggatcttttgatctaatgacatacaggcttagcactcaggtaaaacctcttatctgggtcgaagcacagattgagaaacattctagaagccgtatagaactcatggtgaaggcaaggagtcagttcaaggaaagaagcacagcaacaaatgttgaaattgaagtgcctgttccttcagatgccacaaacccaaatataagaacttcaatgggttctgctgcatatgctcctgagagagatgcaatggtctggaaagtaaaatcattccctggtggcaaggaatacatgtgcagagcagaatttagtcttcctagcataacagcggaagaaggggccccagaaaagaaggcaccaatacgagtgaaatttgagataccatatttcaccgtatcaggtattcaggtccgttatctgaagataattgaaaagagtggttaccaggcactcccctgggttagatatatcacgatggctggcgaatatgagctgagacttata

SEQ ID NO: 5660 - DNA, 1266 bp, Zea mays
atggagatacaaacttcagggaagcccattgatgtgctgatggagaaggttcttagcatgaacattctgtcttctgattactttaaggagctctataggttgaaaacctatcatgaggtcatcgatgagatctacaacactgtcaaacatgtggagccttggatgactggcaattgcagaggcccctccactgcattctgtcttctatacaagttctttaccatgaagcttactgtcaaacagatgcacggtttgttgaagcatcctgactccccacacattagagctattggtttcttgtatcttcggtatgttgcagacccaaaggttctttggatgtggtatgagccctatttgagggatgatgaggagttctcccccggatctaatggccgcaagacaaccatgggtgtttatgtgcgtgatcttatacttggacagtactactttgatagtcttctaccaagaattcctctcccagtaactcgtcagattacagccaatcttgaaaagatgaaattgcccactaagctttctggggcaactggagactccagtcgtcagggatcagaagatactgcacgccgtcctccttcagtgaaagcttctctgtcagtttcctttggacagcgtgctccacatcgggcttccaccagggattcatctccagttcgtcgaacagtcacccgtgatggtcatcgaagttcatactcaccatctcgtcgtagtggtagccgtgagggtcctgatcatgaccgttctgaccgggaactggatcattctagtcgtgaccgtgaaagagcccgggatcgttcaaaccgggatcggtatcattcaagccgagaccttgaccgtgacaaggatgccagagattatcatcggcatgagcgtgatagcagggatcgtgagtactacaggtccaggcattcagaagaaagacgggacgacagaagagatcatgaaagtagcaggcacaggcgctctagctctcgccacaggagcaggagtaggagccgaagcaggagcaggagtaggagcaggagaagccgcagccgaagcacgagcaggaggagcctgaatgagcagcgatccagcccattcagggatgcaaataaagagaaggcagccaccgtgtcgagcaacctagcaaagctgaaggacttgtacggtgacataactgcaaagaaggaagacagtgatgctgaaaagcttcaccgtgattcatgcgctgaggaggtcatcaggctgggaggccctcgatggagg

SEQ ID NO: 5661 - DNA, 606 bp, Zea mays
atgggtgttactcactgtaccattgcccatgcgcttgagaaaactaagtaccctaactccgacctctactggaagaagtttgaggatcactaccacttctcgtgccagttcaccactgacttgattgcaatgaaccatgccgacttcatcatcaccagtaccttccaagagatcgccggaaacaaggacaccgtcggccagtacgagtcacacatggcgttcacaatgcctggcctgtaccgcgttgtccacggcattgatgtgttcgaccccaagttcaacatcgtgtctcctggcgcggacctgtccatctacttcccgtacaccgagtcgcacaagaggctgacctcccttcacccggagattgaggagctcctgtacagccaaaccgagaacacggagcacaagttcgttctgaacgacaggaacaagccaatcatcttctccatggctcgtctcgaccgtgtgaagaacttgactgggctggtggagctgtacggccggaacaagcggctgcaggagctggtgaacctcgtggtcgtctgcggcgaccatggcaaccccttccaagggacaaggaggagcaggccgagtccaaaagatgtt

SEQ ID NO: 5662 - DNA, 588 bp, Zea mays
  misc_feature (553)..(553): n = any nucleotide
atgtcgcgcgcgcaggacgggatcctcaggtacatgctcaagatgatggaggtctgcaacgcgcagggcttcgtgtacggcatcatcccggagaacggcaagcccgtcaccggcgcctccgacaacctccgcgcctggtggaaggagaaggtccgcttcgaccgcaacgggcccgccgccgccgccaagtaccaggcagacaccgccgccgcgggaggcggggccgcggacgggtgcggaggcgccgacgcggaaggccagcatcactccctgcacgagctgcaggacaccacgctgggctcgctgctctccgcgctcatgcagcactgcgacccgccccagcgccggttcccgctcgagagaggcgtgccgccgccgtggtggccgctggccgccgtgcccgtacaagaagccgcacgacctcaagaaggcgtggaaggtgggcgtgctcagggccgtcatcaagcacatgtcgcccgacgtcgacaaggcgcgccgcctcgtccggcagtccaagtgcctgcaggagaggatgacgccagggagatggtcncgtgggtcgccgtgctcaggcaggaggaggagctc

SEQ ID NO: 5663 - DNA, 477 bp, Zea mays
atgtcgctgattcgccgtggaaacgcattcgaccccttctccctcgacctctgggaccccttcgagggcttcttccccttcggctccggcggcgtccgcagcctcgttccctcgttgccgcgcaccagctcggagaccgcggcatttgccggcgcgcggatcgactggaaggagacccccgaagcgcacgtgttcaaggcggacgtgccggggctgaggaaggaggaggtcaaggtggaggtcgaggacggcaacgtcctgcagatcagcggcgagcgcaacaaggagcacgaggagaagaacgacaggtggcaccgggtggagcgcagcagcggcaagttccttcgcaggttcagactgccggacaacgccaaggcagaccagatcaaggcgtccatggagaacggcgtgctcaccgtcaccgtgcccaaggaggaggccaagaaggccgacgtcaagaacgtccagatcaccggc

SEQ ID NO: 5664 - DNA, 477 bp, Zea mays
atggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtcccgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggcggttatggtggcgggcgccgtgacggcggttatggcggcggtggcggctacggcggtcggcgcgaaggtggcggcggcggctacggaggcggtggcggctacggcggtcggcgcgagggtggcggtggcggctacggcggcggtggcggcggcggctggagggac

SEQ ID NO: 5665 - DNA, 456 bp, Zea mays
atgtcgacgccggcgaggaagcggctgatgcgggacttcaggcgcctgcagcaggacccgcccgccgggatcagcggcgcgccgcacgacaacaacatcatgctctggaacgccgtcatattcgggccggatgatacgccgtgggacggtggcacgttcaagcttaccttgcagtttacagaagattacccaaacaagccaccaactgttcgatttgtctctaggatgtttcatccaaatatatatgctgatggaagcatctgtttggatatcctacagaaccagtggagtcctatatatgatgttgctgcaattttaacttctatccagtccctgctgtgtgatccaaacccaaactcccctgcaaactcagaagcagcaagactgttcagcgagaacaagcgggagtacaaccgcaaagtccgtgagatcgtggagcagagctggacagccgac

SEQ ID NO: 5666 - DNA, 177 bp, Zea mays
atgcccccgtcccggctcggcctggcgctccgccgcacctccttctcccacgcggcgcccccgtacgacgccgaggacatgagcaggctgcggtgcgaggcggaggagcgcgcgccgtcgtcggcgccgccgccgccgccggcggagaggtggaaggagcgcgagaggagggacggg

SEQ ID NO: 5667 - DNA, 417 bp, Zea mays
atggcgtattcggcacccgaacccagaggcggtgtggttgtgggcgctttcggtgacgtgcgaggtctggttcgccttctcctggcttctcgacagcctccccaagctctgccccatccaccgggccgccgacctggatgtccttgccgagcgcttcgagctgcccaccgcccgcaatcccaagggccactccgacctgcccggcatcgacgtcttcgtctccaccgccgacccggagaaggagccgccgctcgtcacagccaacaccatcctctccatcctcgcggccgactacccggtcgagaagctcgcctgctacctctccgacgacggcggcgcgctgctcaccttcgaagcgctcgccgagacagcaagcttcgctcgcacctgggtgccgttctgccgcaagcacggcgt

SEQ ID NO: 5668 - DNA, 675 bp, Zea mays
atgccgttcctgcggggggtggacgtgaaccgggcccctgccggggataccaggaggggtagctgcagcgaggacgacgaggagcctggcggcgcgtcgtcgtcgccaaacagcacgctctccagcagcctcagcgggaagcgcgcagctccggcgaggagcggcggagaggtggccgaccacaccccgagagccggaggcggcagcgacgacgaggactccggcggtgggtcgcgcaagaagctccgcctgtccaaggaccaggccgccgtcctcgaggagagcttcaaggagcataacacactcaaccccaagcagaaggcggcgctggcgaagcagctgaacctgaagccgcgtcaggtggaggtgtggttccagaaccgcagagccaggacgaagctgaagcagacggaggtggactgcgagttcctgaagcgctgctgcgagacgctgacggaggagaaccggcggctgcagcgggaggtggcggagctgcgcgtgctcaagctcgtggcgccgcaccactacgcgcgcatgccgccgcccaccacgctcaccatgtgcccctcctgcgagcgcctcgcctccgcgtccgcgtccgccgaccaggcgggccgtgcagggccctgctggggccctctccccgtgttcgtcgacggcccagcccggaggccg

SEQ ID NO: 5669 - DNA, 807 bp, Zea mays
atgacgcccgagaggaggatggcgatctgggcaatatacgtgtggtgcaggagaacggacgagctcgtggacggccccaacgcgtcccacatctcggcgctggcgctggaccggtgggagtcgcggctggaggacatcttcgccggccggccgtacgacatgctcgacgccgccctgtccgacaccgtcgccaggttccccgtcgacatccagccgttcagggacatgatcgaggggatgcgcatggacctgaagaagtcccggtacaggagcttcgacgagctgtacctctactgctactacgtggccggcaccgtggggctgatgagcgtcccggtgatgggcatctcgccggcgtccagggcggccaccgagacggtgtacaagggggcgctggcgctgggcctggcgaaccagctcaccaacatcctcagggacgtcggcgaggacgccaggaggggacggatctacctcccgcaggacgagctggagatggccggggctctccgacgccgacgtcctggacggccgcgtcaccgacgagtggaggggcttcatgaggggccagatcgcgagggccagagccttcttcaggcaggcggaggaaggcgccaccgagctcaaccaggagagccgatggccggtgtggtcttctctgctcctgtaccggcagatcctcgacgagatcgaggccaacgactacgacaacttcacccggagggcctacgttccgaagacgaagaagctgatggcgctgcccaaggcgtacctgagatcactggtggtgccctcctcctcttctcaggc

SEQ ID NO: 5670 - DNA, 423 bp, Zea mays
atgggctgcgaggaggaagagaggctgctgttcccgtccttcgtctttcccgagagcttcgcggaggccgccacccccggctccggtggtgagcagaagaaggctcggcagcgtcggaggcgcaagccgcggccggcggagggcggcgagggcgcggacgagcaggccaggaagcggcggctgagcgacgaccaggcgcggttcctggagctcagcttcaggaaggagcgcaagctggagacgccccgcaaggtgcagctggccgccgagctgggcctcgacgccaagcaggtggccgtctggttccagaaccgccgcgcccgccacaagagcaagctcatggagggaggagttctccaagctccgcgccgcgcacgacgccgtcgtcctccacaactgccacctcgagaccgaggtacctgc

SEQ ID NO: 5671 - DNA, 993 bp, Zea mays
atgaagaagtgcccatcggagctggagctggaggctttcctccgcggccgggaggacgccacggcggcggcggcggcggcggtggccgagcagaagcctacgcacgacatcgctgcgctggcgccgttcggcgccggtggcgtgttcccctccagcgatctgtccgccttcagcttcgctgactcgaacaccctcaatggaactggaaacatccataatcacctttggtcccataaccacaacgtcaggcatcccgcagtctccacgacgatcgagtcgcagtcgtcgatctgtgcagctgcagcagcaagtccaacatcggctaccaacctgtacctgaaagagagccaggctctgggcggcacgagtggttccgactccgacagcgattcgctgctggacatcgagggtggcccgtgcgagcagagcacgaacccacaggacgtgaagaggatgcgacggatggtgtcgaaccgtgagtctgctcgacggtccaggaagaggaagcaagcccacctagctgaccttgagacacaggtcgaccagctgcgaggcgagaacgcgtcgctcttcaagcagctgacggacgccaaccagcagttcacgaccgcggtcacggacaacaggatcctcaagtcggacgtggaggccctcagagtcaaggtgaagctggcggaggacatggtggcgcgcggcgcgctgtcgtgcgggctgggcagcctggggctgtcgccggcgctgaacccgcggcaggcgtgccgcggccccgacgtgctgtccgtgtccggcctggacttccccggcgccgacgacgcctgcttcacggggctgtccccggcggagcagctgcagctccagagctcccccctgcagagcatcgccgccagcctcgagagcctggacaaccggatggccagcgaggtcaccagctgcggggggcccggcgtcgacgtctggccgtgggaccaccactccaacggcggcctgtccaag

SEQ ID NO: 5672 - DNA, 408 bp, Zea mays
atggcccgcacgaagcagacggcgaggaagtccaccggcggcaaggcgccgaggaagcagctggcgactaaggcggcccgcaagtctgcccctgcgaccggcggagtgaagaagccccaccgcttccgccccggcaccgtcgcgctccgggagatccgcaagtaccagaagagcacggagctgctgatccgcaagctgccgttccagcgcctggtgcgggagatcgcgcaggacttcaagaccgacctacgcttccagagctctgctgtctccgcgctgcaggaggcggctgaggcctaccttgtcgggctcttcgaggacaccaacctctgcgccatccacgccaagcgcgtcaccatcatgcccaaggacatccagcttgcccgccgcatccgcggggagagggcc

SEQ ID NO: 5673 - DNA, 387 bp, Zea mays
atgcagatctttgtgaagacgctgacagggaagaccatcaccctcgaggtcgagagcagcgacaccatcgacaatgtcaaggccaagatccaggacaaggaagggatcccgccggaccagcagcggctgatctttgccgggaagcagctggaggatggccgcacccttgcggactataacatccaaaaggagtctacgctccacctcgtgctcaggctccgcggtggcatcattgagccctcgctgcaggcgctcgctcgcaagtacaaccaggacaagatgatctgccgcaaatgctatgcacggctgcaccctagggctgtcaactgccgcaagaagaagtgtggtcacagcaaccagctgagggccaagaagaagatcaagaac

SEQ ID NO: 5674 - DNA, 387 bp, Zea mays
atgcagatcttcgtgaagacgctgacagggaagatcatcaccctcgaggtcgagagcagcggcaccatcgacaatgtcaaggccaagatccaggacaaggaagggatcccgccggaccagcagcggctgatctttgccgggaagcagctggaggatggccgcacccttgcggactataacatccaaaaggagtctacgcttcacctcgtgcttaggctccgcggtggcatcattgagccctcgctgcaggcgctcgctcgcaagtacaaccaggacaagatgatctgccgcaaatgctatgcacgactgcaccctagggctgtcaactgccgcaagaagaagtgtggtcacagcaaccagctgagggccaagaagaagatcaagaac

SEQ ID NO: 5675 - DNA, 531 bp, Zea mays
atgtcgtccgcgccgagcaccacggcgtccaccatcgcagcctctatccacacgccgttctcctcgggtccccgcggggcccgccttccggccgcgctccgcctctcgctcgctcagctccggtcggccggatgccgcgcggcgccaggtcgcctcgctcgccctcgcgcgcgcgttcggtgcggcgcggcggccaggttcattgggcagggcgagttccccgcggaggtgctggagtcggagctgcccgtgctcgtggacttcgtcgccgactggtgcgggccgtgccgcctcatcgcgcccgtcgtcgattgggcctccgaggaatatgctgggcgattaaaaattgtcaagattgatcatgatgccaatccacagctgattgaagagtacaaggtttatggtctcccgactttgattctcttcaaggatgtccaagaggtgccaggcagccgacgagaaggggcaatgataaaagacaagttcaaggaatacctggaacctctgttgactacaattacaacagccgct

SEQ ID NO: 5676 - DNA, 1137 bp, Zea mays
atgaacaccaccgacgtcggcaagcagttcaccatgtccgaggtgcgcaagcacgcgtcgcaggagtcggcgtggatcgtcgtgcacggccacgtctacgactgcaccaagttcctcaaggaccacccgggcggcgccgacagcatcctcatcaacgccggtaccgactgcaccgaggagttcgacgccatccactccgacaaggccaaggcgctcctcgacacctaccgcatcggcgagctcatcaccacgggcaccggctacagctccgacaactccgtccacggcggctccgtcctgtcgcacctcgcgcccatccgcgaggccgtcagggctcccgcgctctccaacccgcgcgaaaagatccactgccgcctcgtcggcaagaaggagctgtcccgcgacgtccgcctcttccgcttctcgctgccgtcgcccgaccaggtgctcggcctccccatcggcaagcacatcttcgtctgcgccagtattgaagggaagctgtgtatgcgggcgtacacgcccacgagcatggtggacgagatcggccacttcgacctcctcgtcaaggtctacttcaagaacgagcaccccaagttccccaacggcggcctcatgacccagtacctcgactcgcttcccgtcggctcctacatcgacgtcaagggcccgcttggccacgtggagtacaccggccgcggcagcttcgtcatcaacggcaagcagcgccatgcgagccgcctcgccatgatctgcggcggaagtgggatcacgcccatgtaccagatcatccaggcggtgctgcgcgagcagccggaggaccacacggagatgcacctcgtgtacgccaaccggacggaggacgacatcctcctccgcgacgagctcgaccggtgggcggccgagtacccggacaggctcaaggtgtggtacgtcatcgaccaggtaaagcgcccggaggaggggtggaagtacagcgttgggttcgtcacggaggccgtcctgcgggagcacgttccggaaggtggggacgacacgctggcccttgcctgcggaccaccgccgatgatccagttcgccatctcgcccaacttggagaagatgaagtacgacatggccaattctttcgtcgtgttc

SEQ ID NO: 5677 - DNA, 1287 bp, Zea mays
atgaggaagccagaagaaatcacaaaagaagaatatgctgccttctataagagcttgacaaatgactgggaggagcatctggctgtgaagcacttctctgtggagggtcaactggagttcaaggctgttctctttgttcctaagagggccccctttgatctctttgacaccaagaagaagcaaaacaacatcaagctctatgtgcgcagggtgttcatcatggacaactgcgaagagctgatccctgagtggctgagcttcgttaagggtattgttgactctgaggaccttcccctcaatatctctcgtgagactcttcagcagaacaagatcctgaaggtgatcaggaagaaccttgtgaagaagtgtgttgagctcttctttgagattgctgagaacaaggaggactacaacaagttttacgaggctttctccaagaacctcaagcttggcatccacgaggactcgcagaacaggaccaagatcgccgagcttctgagataccactccaccaagagtggtgatgagctgaccagcctcaaggactacgtgaccaggatgaaggagggacagaatgacatatactatatcactggtgagagcaagaaggcagtggagaactcccccttccttgagaagctgaagaagaggggctatgaggttctgtacatggttgatgccattgacgagtatgctgttggtcagctcaaggagtttgagggcaagaagcttgtctctgccaccaaggagggtctgaagcttgatgagactgaggacgagaagaagaggaaggaggagctgaaggagaagtttgaggggctgtgcaaggtcatcaaggaggttctgggtgacaaagttgagaaggtggtggtgtctgatcgcgttgtggactcaccgtgctgccttgtgactggcgagtatggctggaccgccaacatggagaggatcatgaaggcacaggccctgagggactcgagcatggcgggctacatgtcgagcaaaaagacaatggagatcaacccagagaaccctatcatggatgagctccgcaagcgtgccgaggctgacaagaatgacaagtcagtcaaggatctcgtgatgctgctgttcgagactgctctcctgacctccggcttcagcctggatgaccccaacaccttcggcaaccggatccaccgcatgctcaaactcggtctgagcatcgatgaggacgagcctgttgaggcagaggctgagatgcctcagcttgaggacgacgctggtgaaagcaagatggaggaggtcgac

SEQ ID NO: 5678 - DNA, 474 bp, Zea mays
atgcccgtacggttcaggacctttggcgccgaacgcgggaccgcagcgccgggagttttcgcgtcggtaggcggcagtgtggcgttcgcaagcaacggcgctaggagggccgagggtgccagcggccccaatgacaccgcccgccgcggcccgcccagcaggttgacggcgtcgcgcgctgcgagggcgaggatgtcggcgcaggagacggtggccttgcaggacgcctccacctgggccttgatggcgtcgatgacctcgtacccgcgcagcgagttggcgttgggccccgcgttcttctccccggtgaagttaccgggcacgtcgtccagcaagacggaggcgtcgcagccattgacgaagcagtcgtggaagaagaggcggaggagggacgcccccatgcgcggctccgcccggacggcgcgcgccacgccgcggcgcacgatgggctgcagccccgggcacgtcgcgtcg

SEQ ID NO: 5679 - DNA, 291 bp, Zea mays
atgtccagtaagtcctcaactgttggttgtccagaagctgatgtctttgtagcattcagtatcccaaatgtaagatatccaccaaacttgagcgctaacactcttgacattaaacctttttcactcattacgagtccaatcataggcacttggcagtgtaccatcacttggaacatccgtgatacatcgacaatgtccttggcggttgttgcaactttcactatatcagctccaactgcttgtatactagcgacaagatttgtaatttcctcacatgatggagtatattca

SEQ ID NO: 5680 - DNA, 507 bp, Zea mays
atgttcgtcgcgccgtccaggggcggcgccgcggcgaggggccccggcgccggcgccgcggaggagttcgacgagtcggacgtctggggctcgttcggcgcggactcccagtactccagccccggggccgagctgggcgccggctgggcgcgcccgatccccggctccggcgccaggcggaagaagcccgtggacggcggcggcggcggcggcgcggcggggtcgctgccgatgaacataccggactggcagaagatcctcggggtggagtaccgggaccaccaccgcgcgggcgagtgggagcctggcgcggacgacgacgacgacgacgacggcagcagctacggcagggcgcgcggcggggcggagatggtgccgccgcacgagctggcgtggcgcagccgggcggcgtcgctgtcggtgcacgaggggatcggcaggacgctcaaggggcgcgacctcagccgggtccgggacgccgtctggaagaagaccggattcgaggac

SEQ ID NO: 5681 - DNA, 747 bp, Zea mays
atggcggcggcggcgagacagcgggggacggtgaagtggttcaacgacaccaagggcttcgggttcatctcccccgaggacggcagcgaagatctcttcgtgcaccagtcgtcgatcaagtcggagggcttccgctcgctcgcggagggcgaggaggtggagttttccgtctcggagggtgacgacggccgcactaaggccgtcgacgtgaccggccccgacggatccttcgtcaggggcggcggaggcggaggaggaggcggcggcggctacggctcccgcggcggtggcggatctggcggcggcggtcgcagctacggtggtagctggggcggcggccggagatccggcggcgggggcggtcccggcgcgtgctacaagtgcggcgagcccggccacatggcaagggactgccctagcgccgacggcggaggcggctacggcggaggcggctacggcggcggcggctacggaggaggaggcggcggcggcggtggctgcttcaagtgtggcgagcctggccacatggccagggactgctccagcggcggcggcggctacggcggtggcggcggcggcggtggaggcggctgctacaactgcggccaggccggccacatggccagggactgccccagcggtggcggcggtggcggagggaggttcggcggcggcggcgggggtggcggcgaccgctcctgctacaactgcggcgaggccggccacatcgcccgcgactgccccacg

SEQ ID NO: 5682 - DNA, 480 bp, Zea mays
atgcagcacgtgacgcagctgtcgttcctcctgctggcctactccaactacctgagccacgccggcgggcgcgtctcgtgcggctcgtcgtcggcgtcgccggtgcagctccgccgcgtggccaagcggcaggtggactacatactgggcgacaacccgctgcggatgtcgtacatggtggggtacggcgcgcggttcccgcggcggatccaccaccgcgccagctcgctgccgtccgtggcggcgcacccggcgcggatcggctgcaaggccggcgccgcctactacaccagcccggcgcccaacccgaacctgctcgtgggcgccgtcgtgggcgggcccaccgacgactccgacgccttccccgacgcgcgcgccgtgttccagcagtccgagcccaccacgtacatcaacgcgccgctcatgggcctcctcgcctacttctcggcacatcccaacccagccgagtcgggcggcgac

SEQ ID NO: 5683 - DNA, 1710 bp, Zea mays
atgtttggaattagggatgccgaccaccaagaccagatgaagccgctgcttgcgcagcagcaccagcaccagcaccagcaccagatgccacctgcgccgctgctcaacgccgcttcgtcgtcggcggggcccggccaggcggcaggggcaaccccgccggcagtgaagaagaagagaaacctaccagaccctgacgcggaggtgatcgcgctatcgcccaagacgctgctggcgacgaaccggttcgtgtgcgaggtgtgcaacaaggggttccagcgggagcagaacctgcagctgcaccggcgcgggcacaacctgccgtggaagctgaagcagaaggacccgtcgcaggcgcagcggcggcgcgtgtacctgtgcccggagccgacgtgcgcgcaccacgacccctcccgcgcgctcggcgacctgacggggatcaagaagcacttctgccgcaagcacggcgagaagaagtggaagtgcgacaagtgctccaagcgctacgccgtgcagtcggactggaaggcgcactccaaggtctgcggcacgcgcgagtaccgctgcgactgcggcacactcttctcgcggagggatagcttcatcacccacagggctttctgcgacgccctcgcgcaggagagcgcccggctgccgcccccaggcctcaccgccagccacctctacggcgccaccaacgcggccaacatggggctcagcctctcgcaggtcggttcccacctcgcatccacactcggtgcggacgctcacggccaccatcaggacctcctccggctcggtggcagcaacgccgcgagccgctttgagcatcttctggggccgtccaacgcctccgcgttccggcccctgccgcctccaccatcgtcggcatttctcatgggcgctccgcaggagtttggcgcaggcgacggcagcgggtcccacgggttcttgcagggcaagccgttccacagtctcatgcatctgccggatctccaaggcaacggcgccgggggtgcctcggcgtcgtcggctacgggtctcttcaaccttggctacatcgcaaacagtgcaaacagctcaggtacttccagccatggccatgcaagccagggacacctgacaagtgatcagttcagcgaaggaggtggcggcggcggctccgagtcatcggccgcgatgctttttagcggcggcgggaacttcgccggtggtgaccaccaagttgctcctggcgggatgtacaacaatgatccggccgtgatgctgccgcagatgtccgcgacggcgcttctgcagaaggcgtcccagatgggctccagcgcgagcgcgcacggcggcgtgtccgtgtttggggggctcgtgggctcgtcggcgccctccgctaggcacgcccgggcacccatgctcgaccagagccagatgcacctacagagcttgatgagctcgctggctgccggcggcatgttcggcggcgccaacagcggcagcatgattgacccgaggatgtatgacatgaaccaagatgtgaagtttagccagggccgtggtggcgctgagatgacgcgcgacttccttggcgtcggcggcgatggtgtcatgagaggcatgacagtggcgagagcggggcaccaagacggtgccgatgacatgaactccttggaagccgagatgaagtcggcctcgtcgcccttcactggagacaggatgcaa

SEQ ID NO: 5684 - DNA, 606 bp, Zea mays
atggccgtagtcatcagcgcggaccgtatcgccgccggcgaccacccggggtgcgcggaccggagcagcgcggcggcgccgctggcgtgcgggcacgccatggacgtcccggacaggatgttgaactccgtgcggcgggtatcgccctccaggccggtcggacccgtggcgcccgtccacgcggcgaggatgttgacgcccggtgcgatgaagtccggcttgagaatctccgggacgagcccgttgggtccacgcgccgagaaggaggccaccacgggtgccggcttgacgccgacgaccgtgcccccgaagctgattgtcgccatcgggctggaggcgttcgcggcatacgctttgaccgcgtcgccctccttctcgcccaccgcgcaagcagggaggacgtgggcgtctccaaccagtccctcgccgttggcctccccgttagtaaggaccatcgccgcgccaccagcttccttgacgaccattcccttggccacgcgcgggctgctgccgcggtcgcagacgacgatcttgcctttcaccagtgaagggtcgatggagttctccatgcacagcgaagcggagagcccgccagtcctcccgggg

SEQ ID NO: 5685 - DNA, 717 bp, Zea mays
atggacacccatatcggatccgtgaacggggcggcgtcgaaccagacggttggctgcccggcgtcggcgccggggtgcccgatggcgtccacgccggcgcagcccgcggcgaccctgtcggcgggggaggcgtcgctggggcgccacctcgcgcgtcgcctcgtgcaggtcggcgtcaacgatgtattcgcggttccgggggacttcaacctcacgctgctcgaccacctgatcgccgagcccggcctgcgcctcgtcggctgctgcaacgagctcaacgccgggtacgccgccgacgggtacgcgcgcgcgcgcggcgtcggggcctgcgccgtcacgttcacagtcggggggctcagcgtgctcaacgccatcgcgggcgcctacagcgagaacctgcccgtcatctgcatcgccggcgggcccaactccaacgactacgggaccaaccgcatcctccaccacaccatcggcctccccgacttctcgcaggagctccgctgcttccagaccgtcacctgccatcaggcggtggtgaacaatctggatgacgcgcacgagcagatcgacacggccattgccacgggcactgagggagagcagcccgtgtacctcagcatcagctgcaaacctcctgggctgcctcatcctacctttcgccgcgaaccagtgctctttcttcctcccccccaggacgaagcaacaaaattgggtcta

SEQ ID NO: 5686 - DNA, 450 bp, Zea mays
atggccaccgtcctaggcagcccccgcgcgccggccttcttcttctcgccgtcctccctccgtgccgcgccggcgcccaccgccgtggcgctgcctgcggccaaggtgggcatcatgggccgtagcgccagcagcaggggcaggctgcgcgcgcaggccacctacaacgtgaagctgatcacgccggagggggaggtggagctgcaggtgcccgacgacgtgtacatcctggaccaggccgaggaggacggcatcgacctgccctactcctgccgcgcggggtcctgctcctcctgcgccggcaaggtcgtctccggctccgtggaccagtccgaccagagctacctcgacgacggccagatcgccgccggctgggtgctcacctgccacgcctaccccacctctgacgtcgtcatcgagacgcacaaggaggaggagctcaccggcgca

SEQ ID NO: 5687 - DNA, 294 bp, Zea mays
atgcaggccatgccgctcccaccgtccttctgcgccaccggcgccgtacgcttccctttcagcagctaccccgtgacgcacccgtattacttcttcgggcaggcggcagcagggtgccatatgctgaagctgccaccgacgacggtgactgtggctcagagcgactcagactcctcgtcggtcgaggatctgtcgccgtcgccgtcgccgtcgccgccggccgccgtgtcagcgacgagatccgccacgtttgatctcgacctcaactgcccaccgccggccgaggcggaggca

SEQ ID NO: 5688 - DNA, 1149 bp, Zea mays
atggaaggctacgaccgcgagttctaccagttcagcgaccagctgcgcctgcagacggccgccttctcgggcctctccctcggcgactccatctggtcccccgccggccggcgcaacaacagcaacgacgtcctcttcgccgcctccgcgtcgcccgccgacgccgccgccaagagcaacgccgtcgtcgggctcaagctcaacgacggagggcccggcctcatcggctccgggaagctggccttcggcggcggcgccggaggcggcggcaccaacaaggccgaccgctacaacaacaacaacctccccaacaccgacaacaagaccgtgtacaacaccagcagcagcagcttcatgggcaacggcagcagctacgccaagaacaacaacaacaacgccgacatgctggcgttcgacaagatggggagctacggctacaacggcggcggtaataccaacaacaacagcaacggcgtggaggtgaagagctacttcaacaagtccgccgggagggcggcgagcaacaacaacaacaacaacaacagccacgccggcggcggcaacaagaagggcggcgccggggagtacggcaggaaaaagcacgccaagagcgaggggcgcggcgggcggccacggacaagcagcggttcaagacgctgccggcgtcggaggcgctgcccgcgggggccaggccatcggcgggtacatcttcgtctgcaacaacgacactatggacgagaacctcaggagggagctgttcgggctgccgtccaggtacagggactctgtgcgtgctatccgcccgggactgcccctcttcctctacaactactccacgcaccagctccacggcatcttcgaggccgcgagcttcggcgggaccaacatcgacccgacggcgtgggaggacaagaagtgccccggcgagtcgcgctttcctgcgcaggtgcgggtggcaacgcggaagatctacgacccgctggaggaggacgccttccgccccatcctgcaccactacgacgggcccaagttccggctcgagctctccgtcaccgaggccctcgccctcctcgacatcttcgccgacaaggacgacgcctgatccccatcggatctgtcgtcgggccactcgaagctcggatgcacgaa

SEQ ID NO: 5689 - DNA, 912 bp, Zea mays
atgaccacgagatcgccggacatcagctggcagatgagggcagtcagggtgctacccatgttcttggttcctgctctagctgctctcatctactcgaccattacaagcctcacgaaaatgcttgacaacagagaccaacaaactcttgaaaagctacgaactgaaaggcaagccaagattgatgaattgaaggagagaacaaattactacactactcagcaacttatacagagatatgaccttgacccagctgcaaaggcggcagcggcaacagttttggcatcaaagttgggtgcggattctggactgagagtctttttgggagatgaaacaagaagggatgcagcaataggtagaagtaatgataacaatcttggaccaactactggacttaggcaaagaaaaggacacgtaaccaatggtgctggaagggcccaatcccttgagccatttgatggctccaatgtgtatgatggcagtgatgaaggccccagccctcctaatcagactgttgagcactttagaggtccatcgggtaatgatgggggttggcttgcacgagtagcagctctgcttgtaggagaggatccaacacagtgctacgctctaatctgtggcaactgccatatgcataacggtcttgcgaggaaagaggactttgccttcgtcacatactactgccctcactgtaatgccctcaatggatcccggcaacatgatgaccatgaattggtacctgattctggcaaggagagtcctgattctcaatctggcggaatcattggccaagctggtgcaagccttgcaacctcaggtgctgcgagtcctgttgcaagcagcctaccaacccttgaagaactctctgcagaggaagattctggggagaaggcgagcagtgaccaacctgccaat

SEQ ID NO: 5690 - DNA, 552 bp, Zea mays
atgcacgtggcgtggatgcccgtcgagccttggtcaagcaaagaagccattagtgctagtgttagcggcgggcatgtgcggcatctgggccgcctggatgctctgcaggaacatcctctcctccgccgacgcggcgaacccgtgggaggcggcgggggcgaagacgtcgccgccgtcttgcagcaggccgccgccgccgccgttgctatagccgaatggcgacgccgcgccggcgtactgctgctgctgctgctgcctgcggagctgctcctggagcggcgcggggtgctggctccggtgcagctggtggtcgaaggacatgacggcggccgaggacggcgggaagccgtagtcggcggcgaagttgatgaccggggccccgaacgcccccgcggggggcgcggggatgcccgtgaactgctgcaccatggcacggaagttggccgtgtccgtgttcagcagcgtcacgggcgcgcgccgcgacgcgcgggaccgccgccgtcgtcgtcggggggcagcaggaccggcccggcgtcgtggtggtggtggtgg

SEQ ID NO: 5691 - DNA, 486 bp, Zea mays
atgacggcgacgacgacggcggcgacgaggagaagggatacgacgagaaccagaagttcgacgagttcgagggcaacgacgccggtctcttctccaacgccgattacgacgacgacgaccgcgaggcggatgctgtgtgggagagcatcgaccagaggatggactcgcgccgcaaggatcgccgcgaggcgcgcctcaagcaggagattgagaagtaccgcgcgtcaaaccctaaaatcaccgagcagtttgctgatctcaagaggaagctggctgatctgtccgcgcaggaatgggagagcataccggaaattggggactactcgctgcgcaacaagaagaagcggtttgagagcttcgtgcccgtgccggacaccctgcttgagaaggctcggcaggagcaggagcatgtcacagctcttgaccctaagagccgtgcggctggtggcacagagacgccatgggcacagactcctgttactgatc

SEQ ID NO: 5692 - DNA, 534 bp, Zea mays
atgctgtgtccatgcatgcatcatgttctcgtatataatgtcagtggcacgttcgttcgatcgtccgcgtgtatatctcagtatctcgtgaaggagaaatccagtgaccccgcgcggcctgccggttcttgcgttgcagcgttccagtacagctcggcgcactcggtgctggaggtgagcgaggcggaccacggcgcgtgctcggcgagcaacccgctgcggtcgcaccagggccagagcaccaccatcccgctcaccaaggccggcacccgctacttcatctgcggcgcccccggccactgcgcctcgggcatgaaggtcgccatcaccgtctccggcggcggcggcggcggcagcagcagcgccgacaacaccgcgactccgtcgggtccctccgtgcgggcgacgaacacgaagccggcgtccggtggcgcgacgacgacggacgagtcggactccagcgcggctggcagcggcgcccgcctcgcgatgggcctgctgttcggggccgcgggcctcgctgcaataatgggc

SEQ ID NO: 5693 - DNA, 519 bp, Zea mays
atggcctcccgcctcgccgtcgccgtcgccgtcgccgcgcccgcgtcgtctccttccccggtcggcaccgtcgccccgccccgcgtcgccctccgccgaggcctcccgccgacgtggaacgctctccgcgccctccctcgatcccgtggcgcggccgtcgtgtgccaggcccagggcggccaggacaccgccatccaagttcctgatgtgagcaaatccacatggcaatcacttgtggtggagagcgagcttcccgtcctcgttcagttctgggcctcatggtgtggaccgtgtaagatgatagaccccatcgttggcaagctctcgaaggagtacgaaggaaagctgaagtgttacaagctaaacaccgacgagaaccctgacatcgcgacccaattcggcatccggagcatccccaccatgatgatattcaagaatggtgagaagaaggacgcggtgattggagccgtgccagagagcaccctggtcacctgcatcgacaagtacgttggtgggagg

SEQ ID NO: 5694 - DNA, 510 bp, Zea mays
atgggcaagcacctacctgccgccgccaccgccgccgccgccgccgcggttcgctcgtacgcccgcagccttcgcgtcccatccgataccgccgcatccgccgggagggcagataagacgccgtctgccccgctggatacgcccaggaaatccgctgccgccgctgccgcggccagctccgggcgggccgaggtgcgggatttggcggcggcgtgcgggctagaggcggacgagagggttccgctcgcggaggtggtgtcggactgcacgaggcggtggttccaggacgcactcaaggaggcgcgcgccggcgacatcaccatgcaggtgctcgtcggccagatgtaccgcagcggatacggtgtcaacaagaacgagcacaaggcaagagtttggatggagaaagcatcaagatatcggtctacagtatggaaagttagcaataaacgtccagggtacaatgccagtgactcggactcaggcacagatgatgctaaggaaacatgcaaa

SEQ ID NO: 5695 - DNA, 795 bp, Zea mays
atgtcctcgcccgcgccctccccgcccgccggggcgccgtcggagccgctcctgctcccgctcccgcccccggagttctactgctaccagtgcgaggccacggtgtcgctgcccgagccggccgcgccctcctcggccaggctcctctgcccgctctgccatagcgacttcatcgaggagaaccctagcaccccgtctccaccaccacctccgccggcgccgcccccaccgcttttcctctccgactcctcctcctcctcgctctcggacgaccccgacgacgacttcgaccttgtcatggaccccgacgtggtgcgcgcctaccttagccgcttcgcccaccgccaccacctccagcagatcggccacggccccggcccgcacggccgaggggagccgcccgccacggccgcctccatcgacgtgctgtccacggtcgaggttgctgagcccaccgtcgtctgcgccatctgtaaggacgacctgaccctcgactacgaggcgcgtaagctaccctgcacccacctcttatcactacttctgaatggaaacctggctcgggatgcacaactcctgccccgtctgccgcttccgcatcccccccgccgacgaccccgaccaggccgcaccgtcgcagcaggacccgccgcccacgcggatcaccatccgcttcagcaccaccacacgccgccgcgtccgcatcggcagcgatgcgccactggcgtctcatatctcggcgtcgcccacgcagctcgcacaggctattaccggggatggagctggtggacctgccaa

SEQ ID NO: 5696 - DNA, 654 bp, Zea mays
atgctttcacctgaatccctgcttttatctttgctcttgtcttttttcttgtctcggtgtttttcttttcggtctttcttatcttggtgcttatccttactcctgtccttgtccttcttttctttaccttcttttctaactttgtccttcttgtccttcttatgcttcttctccttttgtttctccttgtcaagctgctgctgctgctgcaggtgcgaggctagctggccgtcggggcgcgcggtcttggcatatcctggtggcggaaacgggaagcagcgagacatggcacggccgcctcgggcctcggatcacctacccacccccgccgccgccgccgccgccgccgccgccgcctcttcctcctccttgacgactgcacctctcaggctcaaagcaacaggtcctcctccacccgccgccaccggctcactcgtcctgcgccaggaaccaccacaggcatgccctccggcctctcatgcccgcctccggcgacggaatcgcggggatctgtgcccgaattgccctccgcgcgcgcgcgggggtccgaggatccaatccaatccggccacccgcgcgaccgcgacagaatcgggcgccgcgatctcactcgttttagttttcgtttgctcccagcgcccgctgttgtcggag

SEQ ID NO: 5697 - DNA, 453 bp, Zea mays
atgagaattgaagatgcaggatgcaagcatgcaggtgtgctgctcgcgtcgcgcgcgcgtgcgcatgcggtggcaacggggcctcgatctctctcacgtactctcagtgatgcaaggggttggggcccgaaggcaccagcctcttctgcacgccgtaccgcggatcgatcatcgcctcgtcaccctcgccgccagctgctgacggtggaagagtcccgtgccggttccatcgccggtccgcgtggtggtggtggtggtggtggtgttgatgatgaagatggtggtggtggtggtggtgaagaagatagcggtggttgtaaccagcagctgacgaggacgaggcagcgtcgaagcttgtcatggcgagcagcatcttcctcgggacggcggcgggccacctcgccggcctcgtccccgccaggccgccgccgttcccgtggatcaacgcggctg

SEQ ID NO: 5698 - DNA, 405 bp, Zea mays
atgagggctaccgtggccctgtggagggcgaggtcagccttctgcatcaggcagtgggccttctccctcttgagcctcgccatggcggcggcgtgctgcgctgcgcccgcggcgtcccgcagcttcagctcctcgacgtcgacgcgggaggagcccgggaagaggtgcttcgagttctgccagtcgtggatagcagcgttccagtggtcgtgcgcgctccgtttcgctctctgggggcggcaggaaggtgatggctggtggtcgtcggagaaagcaagggctgcgctccttttggtgctactgttgttcctggaaaatcttggtgtggagcttcgttctgaggactcgaatgcccgaggagaatctgttcttgtagagaacctgggagagtaccctgttggggag

SEQ ID NO: 5699 - DNA, 408 bp, Zea mays
atgctgtctacaacaagtccgccttattttaaaattttacatgtatgcaaaagctataaccctcaaagtttaaaatttatggtatatgcacaactacagaacagatggacgcctgctagaagctcattgttcgtcttcggtttcctcgtcatcgctactagcaactctgttgtagttccatctatcctcgacattgttgcccccctcttcttcctcggtctcctcgctgtcatcctcgtacatcactttccttggccactgctgctcctcgggaaggtgctcctcagggaggttcacagctggcgatggcgctgcgtacccttctttgcgcttggagaccttggctggtggcattctagcagtgatgtccggtctgctcctatgggaactcttcgagatgctgcgctt

SEQ ID NO: 5700 - DNA, 615 bp, Zea mays
atggcagcgaggttcgacaccaagagctactgcaggcagagtttggtcggcggcaactacggcctgctaaacaccacgacgttccagcctaaccctgactattacagtgctctactgtggcatcgcctcatggggaccaaagttctagcagtaacattcagcggcacgaacaagatccgcgcgtacgcgcactgcgcgagagattcaccaggaatcactctgctgctgatcaacctgagcggcaacgccaccgcgcgggtctcggtgacggcccaaggggctgccgcggcgcacgcgcacaggcacaggcacgacgcgaggaagcacggcggcggcaggaagttccggcacgtgcacgtccccggcttcgccggcggcggcgaggcggcggcgggcgccgtgagacacgagtaccacctcacccccaaggacggcgacctgacgagccaggtcgtgatgctgaacggcagggcgttggccaccgacgcggcggggaacatccccgccctggaggcggtcgaggtggacgcggcgcggcccatcgccgtcacgccctactccatcgtgttcgctcgcgttccgcatttcagtgccccggcgtgtagggtagaccgg

SEQ ID NO: 5701 - DNA, 1056 bp, Zea mays
atggcggcgatgaccctggatgagcggttcgaaatgctgcggggcatcggggaggagtgcatccaggaggacgagctcaggcgactgcttgagaacaagcccgtacccatctgctacgacggcttcgagccctctggacgcatgcacatcgctcagggcgttgtgaagaccatcaacgtgaacaagatggtcaacgccgggtgcaaggtgaaaatttggatcgccgactggttcgcgcagctcaacaacaagatgggaggcgacctgaagaagatccagacggtagggcgctacatgatcgagatttggaaagcggctgggatgaaccttgacggggtggagttcctgtggtcctccgaggagatcaacaagcgcgcacacgagtactggccaattgtgatggacattgcccggaaaaacaacgtcaaaaggataatgagatgctgccagattatgggcagaagtgatcaggacgacttgactgctgcccagattttttacccttgcatgcaatgtgctgatatatttttcttaaaggctgacatatgccagttggggatggaccaaaggaaggtcaacgtgctagctagggagtactgcgatgacatcaaacggaagaacaaaccaattattctttcgcatcatatgctccctggttttaaagaaggccaggagaaaatgtcaaagagtgatccatcctcagctatctttatggaagatgatgaggcccaagttaatgtgaagataaagcaagccttttgccctcccaaaattgttgaggggaatccttgtttggagtatattaaatacattgttttcccttggtttggaagatttgaggtcatccgtaaggaaagcaatggtggtaacaagacatttacatgcatgaatgaactaatttctgattacgagactggtgctttgcatcctgccgatgtcaaacctgcactggcaaaagcaataaatgaaattttgcagcctgttcgtgatcatttcaacaacaacaacgaagccaaagttcttcttaacactgtcaagaagtacagagtaaccaat

SEQ ID NO: 5702 - DNA, 513 bp, Zea mays
atgggacctgccaggcagggccaagatgggggagaaggagtggtacttcttctgccacaaggatcgcaagtacccgacgggcacgcggaccaaccgcgccacggagaccggctactggaaggccaccggcaaggacaaggagatcttcaggggccgcggcgtcctcgtgggcatgaagaagacgctcgtcttctaccgcggccgcagtggttgaaggcgctcgtggccgactgcgccacgcgcagctgcacgcgcctgctgcttcagtcgggcgaggtggccgcgcggggggggctccagcacgacctcgccatgctgcacgacgtgctccccgccgcggagctcgggctcgccgacgacagcgcccgcgtcgcggcagtgccgccgcgcggcggccccggagctggagctaaaggcaggcgtgctcgcgctgatccaggaggtggagcgggagggagcagagggcaggggaggcgcggttggaagggcaccggcgggcggcggctggtaggg

SEQ ID NO: 5703 - DNA, 486 bp, Zea mays
atgttttgggaaacaagggttccggcttttggagtgccatggccacctcatggtggtactgttgtcctgattgtcgtatcctacgtgttcagatatgctagagttggtcctatagtaatggcaatccatgatgcaagtgacgttttcctggaagtagggaagatgtccaagtacacccattgtgattgcttgccaatgtttcgtttctgttttttgtatttcatggttcttctccgtctcacatattttccgttctggattctgagaagtacaagctatgaggtcttgttgactttggacaaaaagaagcacaactttgatggtcctatatactattatgtgttcaattcccttctattttcactacttgttctccacatatattggtgggttttaatatatcggatgcttgtgagacaaatcaagacaagaaatgttggagatgatgttcgatctgattctgaaggagaagacgaccatgaagat

SEQ ID NO: 5704 - DNA, 1125 bp, Zea mays
atgcgggcagcagaactacacctccatgttcagcttcggcgactcgctcaccgacaccggcaacctgctcgtgtccagcccgctctccaaccacatcgtcggccgctacccctacggcatcacctacttccaccgctccaccggccgctgctccgacggccgcctcgtcgtcgacttcctagcgcaagcgttcggcctgccgctgctgcagccgtacctgcagtcccgcggcaaggacctgcgccggggcgtcaacttcgccgtcggcggcgccaccgccatggatccgcccttcttccaggagatcggcgcgtccgacaagctctggaccaacctgtccctcagcgtccagctcggctggttcgagcagctcaagccgtcgctctgcagctcaccgaaagagtgcaaggagtacttcagcaagtccctcttcctggtcggagagatcggggggaacgactacaactacgccttcttcaagggcaagaccctggacgacgccaagacctacgtccccacggtcgccgccgcggtcaccgatgccaccgagaggctgatcaaggccggcgccacgcacctggtggtgccggggaacctgcccatgggctgctcgtcggcgtacctgaccctgcacccgggccgcaacggcagcgactacgacgccgccggttgcctcaggacgtacaacgacttcgcgcagcaccacaacgctgtgctccagcggaaactgcgggcgctccgggcgaagtacccgcaggcgaggatcatgtacgccgactactacggcgccgccatgtccttcgccaagaaccccaagcagttcgggttcacgcaggggccgctgcggacgtgctgcggcggcggcgggccgtacaacttcaacccgaaggcgagctgcggcgtgcgggggtccagcgtgtgcgcggacccgtcggcgtacgccaactgggacggcgtgcacctgacggaggccgcctaccacgccatcgccgacagcatcctcaacgggccctacaccagccccaggctcctctgatccgaacgccggtggttgaagctcgtcgtccgtccatcggcagccgcagctcatacaactgtagtggcgccaacaatgtggctggcctg

SEQ ID NO: 5705 - DNA, 921 bp, Zea mays
atggagcggctgcagcggatctttggcgcctccggcatggggcagccgccgacggactcgccgctgctcgactcctccgagcaggtctacatctcctccctcgcgcttctcaagatgctcaagcacgggagggccggcgtgcccatggaggtcatgggtctcatgctcggcgagttcgtcgatgactacaccgtcagggtcgtcgacgtcttcgccatgccgcagagcgggactggggtcagcgtcgaggccgtcgaccacgtcttccagacaaacatgcttgacatgctcaagcagaccggcaggccagaaatggttgtaggctggtatcactcacatcctggcttcggttgctggctatcaggcgttgatatcaatactcagcagagttttgaagctttgaaccccagggcagttgctgttgtgatagaccccatccagagtgtgaaggggaaggtggttattgatgcattccgcctaattaatcctcagaccatgatgcttggccaggagccacggcagacgacatcaaatgttgggcacctaaataagccatcgattcaggctcttatccatgggctgaacagacactactactcgattgcaatcaattaccgaaaaaatgaacttgaggagaaaatgttgctgaacttgcacaaaaagaaatggacagatgggctaattttgaagaggtttgacactcattcaaaaaccaacgagcagactgtccaggaaatgctaaacctagccatcaagtacaacaaggcggtgcaggaggaggacgaactgccacctgagaaacttgcgatagcaaatgtaggtcggcaagatgcaaaaaagcatttggaagagcatgtgtccaatttgatgtcatcaaacatagttcagaccctaggaaccatgctcgacacggttgtattt

SEQ ID NO: 5706 - DNA, 936 bp, Zea mays
atgtggcgagggagatcatcaaccaccgctcgctgcgccaacatcatccggttcaaggaggtggtgctgacgccgacgcacctggcgatcgtgatggagtacgccgccggcggcgagctgttcgaccggatctgcaacgccgggaggttcagcgaggacgaggcgaggtacttcttccagcagctgatttgtggcgtcagctactgccactccatgcaaatctgccaccgagacttgaagctggagaacacgctgctggacggcagcccggcgcctcgcctcaagatctgcgacttcggttactccaagtcgtcgctgctgcactcgaagcccaagtcgacggtcggcacgccggcgtacatcgccccccgaggtgctctcccgccgggaatacgacggcaagacagccgatgtgtggtcctgtggagtcactctttatgtgatgctggtcggtgggttaccccttttgaggacccagacgacccaaagaatttcagaaagacgatcgggaggatcatgtcaatccaatacaagataccagagtatgtgcacgtgtcgcaagactgcaaggagctgctttcaaggatctttgttgcaaactctgcaaagagaataacgatcagggagatcaggaaccacccctggttcctgaagaacctgcccagagagctcacggaggctgcgcaggccatgtactacaagaaagacaacagcgccccgacctactccgtccagtccgtggaggagatcatgaagatcgtggagaaggcgcggacgccgcctccttcctccacccccgtggctggcttcggttgggcggaggaggacgagcaggaggacagcaaggatccagacgaggaacacgaggacggcgaggacgagtacgagaagcaggtgaagcaagtccacgccagcggggagtttcatctcagctgc

SEQ ID NO: 5707 - DNA, 225 bp, Zea mays
atggcttcacgcatgacaccttccaagaggccttttcagagaagatcttcagactacgatggccggggcaagtggcagaagacgaagcacccttctccacataaatctcagttcaaaatcgagcctggtgttcccattttccgtattctctgcccggcttcaaaatctggtaatgtgattggcaaaggaggtgccattattgcaaagatacgtcaagaaccagga

SEQ ID NO: 5708 - DNA, 627 bp, Zea mays
atgaacggtgcgccggtgaggtactcagtgaaggcgagcgcgacgaggccgagcatggcgaagcggccgttccagagctcggcgttggcgctcatgacggcgccgctcctggcctcggcgctgtcgcccctgagcagcggcaccagcgaggccacggacagcacggcagccgtggccgcgaaccaggcgagcccggacccgctgccggcctgcgagaggaggcccccgccgcgggacgcctcgacggcgagcgccgacacgaagcccaccatggcgagccggccgttgatgcgctcgggagccgggccgctgaacgccagcgcgtcccacagcccggggctcgccgccgccgccgccttggactttggcgccggggtggtggccgccgccgccgcctcctttggctcggcctcggcgtcgtcgctctgggccctcacggtcacggccaaggcgcgccggcgcggcgcgagcgcagatgcctggagcagcagccgtacagggaaagcgcgacgcgcgccgggggtggcggaggcgagggggctcatggaggccatcaccgtcgctgccattggagtgtatgcgttcgagtcgttggctcgtagcggcaggcaagaggctcgctcgctg

SEQ ID NO: 5709 - DNA, 129 bp, Zea mays
atggaagacggcgacggcgggccggcggcggtgctggggagcttccagatgcagaacgtggaggtggtgtacgacctggcggcgggacgcgtcgggttccggccgagggactgcgcgctccacgccgcc

SEQ ID NO: 5710 - DNA, 573 bp, Zea mays
atgaagctttatccgtgcccccgtgacatgatggcattcagtgcctgcaacaggcccttaccaaacctcagggcggagctcaccagtagccgggggcatccatttcccagagttgtacacgctctcgccgaccttccaccctggaacgtctttcatgatcctcgcctcctcctcaagacacttcttccactctttgacaaatctttcatcctcttctgcttggagcatcggcagtatagcactgcgagcagcaattttctcttctttgagcgctcggcggaccttgttcccctggccgacctggtacatgccatatgcgaaagcaccgaaggtggtgaggaagatggcggtggcgctgggccccgaggtggggatccggcgggcgaagcgcacgggcgcgaaaccgcccggcggcggcccgtcctgcaccaccggcatctccttgatgctggccatccccggcttgttccgcaccagggactccgtcatcttcggtcccggatccggacgccggtacgcacgcttggcggaactagagctccccgcggggatcaaacgagccgaggctgtcgc

SEQ ID NO: 5711 - DNA, 411 bp, Zea mays
atggctgggaagggaggaaaaggattgctcgccgcgaagacgacggcggccaagtcggcggagaaggacaaggggaagaaggcccccatctcacggtcctcccgcgcgggcctccagtttcctgttggacgaatccaccgtcagctgaagcaaaggactcaggcaaatggccgcgttggtgccactgcagccgtctactccgccgccatcctggagtacttaactgccgaggttctggagctggctgggaacgctagcaaggatctgaaggtgaagcgtatcacccctcgccacctacagttggccattcgcggagacgaggagctggataccctcatcaagggcaccatcgcaggtggaggcgtcatcccgcacatccacaagtccctgatcaacaagtcctccaaggag

SEQ ID NO: 5712 - DNA, 138 bp, Zea mays
atgaacaacccgctgaatatcttgcgcatcaattcctccaagtatgtaatgtttgcatgtgtaaaggctagtctattgttgagagattcaataagcgatccatcactttgcttcttcttctccgcattcagctgcctt

SEQ ID NO: 5713 - DNA, 594 bp, Zea mays
atggcgtccgtggcggagctcaaggagaagcacgccgcagctacggcgtcggtgaactccctgcgcgagcgcctccgccagcgccgggagacgctcctcgacaccgacgtggcgaggtactccaagtcgcaggggagggtgccggtgagcttcaaccctacggatctggtctgctgccgcacgctgcagggccatagcggaaaggtatattctctggattggacccctgaaaagaattggatagtcagtgcctctcaagatggaaggttaattgtgtggaatgcattgacaagccagaaaacacatgccataaagctgcattgcccatgggttatggcgtgtgcttttgcacccaatggccaatctgtcgcctgtggtggtcttgatagtgcgtgctctattttcaatctcaattctcaagcagacagagatgggaacatgccagtatcaagaattcttactggacacaagggctatgtctcatcatgtcaatatgtcccagatcaggaaacacgtcttattactagttcaggtgatcaaacatgtgttctttgggatgttactactggacagaggatatcaatatttggtggg

SEQ ID NO: 5714 - DNA, 282 bp, Zea mays
  misc_feature (8)..(8): n = any nucleotide
  misc_feature (25)..(26): n = any nucleotide
  misc_feature (231)..(231): n = any nucleotide
atgcctgntgattccaacccccttnntattttatcccaaaaaagtgggctcagcgcgagattcttctccagcacaagctacatttctttgaatccggtgcaggttttgaataagttcttcacaagggccagaaacaggattattttgttcagaaaggtaccacatttcagaatacttgtgtgtggtggtgatggtactgttggttgggttcttgacgcgatagataagcanaattatgaatcacctccaacccattgcaattcttccagctggcactggcaa

SEQ ID NO: 5715 - DNA, 903 bp, Zea mays
atggcgcgccaccaccagcagcgggcgctgctcctgttcccactcgtcttcctcctcctcctccttgccccgcccctcgccggcgcgtggggaaaggagggccacatcatggtctgcaagatcgccgagaagtacctgtcggagaaggcggcggcggcggtgcaggcgctgctgccggagtcggcgggcggggagctgtcgacggtgtgcccgtgggcggaccaggtgcgctggcactaccactgggccagcccgctccactacgccaacaccccccaagtctgcaacttcaagtattctcgggactgccacaattctcgtggccagcaagggatgtgcgtcgtcggggctatcaacaactacacggaccagctctacagctacggccagaagacttcgtataacctgacggagagcctgatgttcctggcacacttcgtcggcgacgtccaccagccgctgcacgtaggcttccaagatgacgagggcggtaacaccatcaccgtccactggtaccggaggaaagcaaacctccatcacgtgtgggatgtcagcattattgatacggcgatcaaggacttctacaacaagagcatggataccatggtagaggctctcaagatgaatcttacagatggatggtctgacgacatcgtcccctgggaaaattgcaaaaacaaacccccgacctgcgcgaacgactatgcgattgagagcatcccttattcctgcaactacgcctacaaaaatgtggagcaagacctccctttaggggatgattattttttcagtagggaccccattgtggaaaaaaggttagcccaggctggaatcaaattggggttggggcttaatcggatatttggtggaggtgaaacggattatattcccctccaaggacag

SEQ ID NO: 5716 - DNA, 489 bp, Zea mays
atgtttcgcgtggatcagccccggataatgatatatgaacccatccaactggcttgcaagctccacagttttaatctccttgaggttgtggaagccatccccggcccggatggagatcttgctgggcgtgtagctctcgtcgagcttgaaatccacgtagagagcaacaagctgcagctgcaccttcttctggaaccggatgttcaccaggtgcggctccgccccatcagactgccagtaggcgtcgaggttgtcgtcgcgcagggctgcgacgccgttgccgtccttgaaggaactgacgctccacgcggccctcttcgccacctcccgcatgtccgcgtccacagtcagctccgggctccccttcagccgtccagcgcctgggtccaccgccgccgccgccgccgcctcctcggcgtcggattccatcgggaccagtgcgaggggaagaaccggagaagcagtgaagcacactcaccagggcggact

SEQ ID NO: 5717 - DNA, 399 bp, Zea mays
atgacgcagtcgggcgtggcggagcagatcctggacctaggcgtgctgggctaccgcgccccggagctggccgcgtccaagaagccggcgccctcgttcaaggccgacgtgtacgccttcggcgtcgcgctgctggagctcctgacgggccggtgcgccggggacgtcgtctcggggcccgagggcgccgcaggcgtcgacctcaccgactgggtccggctgcgcgtggcggaagggcgggggtccgactgcttcgacgccgccatggcctcggactctgagagcaacccgcaggctgtgaagggcatgaaggaggccctgggcattgcgctgcggtgcatcaggccggtctccgagaggccggggatcaaatctgtgtacgaggatctttcgtcgatc

SEQ ID NO: 5718 - DNA, 510 bp, Zea mays
atggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaagctcgggttcgtgtaccgcgagaactccacctccccgtgctactacgacggccgctactggatcatgtggaagctgcccatgttcggctgcaccgacgccacgcaggtgtacaaggagctgcaggaggccatcgccgcgtacccggacgccttccaccgcgtcatcggcttcgacaacgtcaggcagacgcagtgcgtcagcttcatcgcctacaagccccccggcagcgag

SEQ ID NO: 5719 - DNA, 906 bp, Zea mays
atggggggttttgtcaagacccacaagaccaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgaggacaatgttgaggccactggtgaggacttctctgttgagccagctgatgagaggaggcctttccgtgctctcttggatgttggccttattaggactacaactgggaaccgtgtctttggtgccctcaagggagctttggatggtggactggatattcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaagaagggaattgaggctgatgacatggaagctctgtacaagaaggtccatgctgccatccgtgctgatccttctgtggtcaagtcaaccaagcagccaccaaaggagcacaagaggtacaaccccaagaaactgacatacgagcagaggaaggccagtctcattgaaaggctcaaccaactcaactcctcgggcggcgcagatgacgacgatgaggatgacgag

SEQ ID NO: 5720 - DNA, 660 bp, Zea mays
atggcctgcatgatgttgatccgtcgcagattcttgctgtcatttggacgtagttgggatgcggtgacgtacaagcaaccatggccaccacccgtgcatgttgtgatactaggagatggcttgtccgtcaggcttacaccttggcaaccatttgatactgatatctacagctttcctgtgaacagaccagaatcatctgcaagtgtctttggtattgcaacagaatcaacgcagtgtgcctatgattcccaaggaaacagtgtctcgacaatcctcttgatgatgcaaagatgcctttatgaacagatgatgcaatacaaatctgaagagggctgtactcgggtagtgaaatgcctcccaccggctgacgcaagtttacttgtctgggctgttaatcagatgacagatccattgattgcattgatgtatgcggtccaagtgatgatttttctcaaggacaaagatgagtcacctcgagaggatgttttgctgctccagaaggacccatttgatggcaacaggcatcagaaacccaacgtgacacttgccatctccttgaggaaagatctaggagtcattgctgcgtgcactgccccaaccaacgaagtaccaacatatgtggaggactacactagtagctcaaaatctgcaactgctggc

SEQ ID NO: 5721 - DNA, 378 bp, Zea mays
atggctgctaggcgctgggcttccttccttccttacttcgtacgaggctggtgtgtgtgtggtggtggtggtggtggtccggacgtccagttccctccctggctccctccctcctcaggctcgatctccttcttgcctcgcactccaactcgggtgatgaacgaacaagagaagagaatagaggagcgaggtgcgagaaaaaggaggccaaaagcagccgctgctgccttgttggggtatgcaagtacttttctcttttgttatccccttggcaaagactcttccaacctaggagagctcggagcagaggaggcgaaaagcgcccgcccgcccgcgggtagcggagccggtggaggattgcgttgtgttgtgtgtgcc

SEQ ID NO: 5722 - DNA, 348 bp, Zea mays
atgatatacacggcgatcgacacgttctacctgacagatgagcagctccgtgactcgccatcacggaaggatgggatcgacgaggccaccgagactgcgctccgcgtctatggctgtgacctcatccaggagagcggcatcctcctcaggctaccacaagcagtgatggccacggcacaagtattgttccatcgcttttactgcaagaaatcatttgttcgatttagtgcaaagagagttgctgctagctgtgtttggctggcagggaagttggaggagagtcccaggaaatcaaggcatattatatttgtcttccacagaatggaatgtaggagagaaacttgccat

SEQ ID NO: 5723 - DNA, 666 bp, Zea mays
atggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcagggcaagagaagtttggtggcctcagggatggatactatatccatggccagtgtgcgatcatcatgtttgatgtaacctcaaggcttacttacaagaatgttcctacgtggcatagggacctgtgcagggtctgtgaaaacatccccattggtccctgcgggaataaggctggtgtgaagaacaggcatgtcaaagccaaaccggttacttttccacagggaagaagaatctcaggttctatgaaatttttgccaaagagcaattacaactttgagaaacctttcctgtacctcgcaaggaagctggttggtgatccgaaccttcactttgttgaagctgttgctcttaagcctccggaagttaccatcgacatggctatgcagcagcagcatgaagctgagcttgctgcagcagctgcacaacctcttcctgatgacgatgatgatctgattgag

SEQ ID NO: 5724 - DNA, 546 bp, Zea mays
atggaaagggcacaggccgaggtacgtgagaagctccaagggaagccaacggtgaccgaagatgacttggtcgacatgaggtacatgaagctcatcatcaaagagaccctaaggatgcatccggtggtgccattgcttctcccaagggagtgccgagagccatgcagggtgatggggtacgacgtgcccaagggaactaccgtgttcgtgaatgtctgggcgatcagcagggatcccaagcactgggaggacgctgcgacgtttagaccggaacgattcgaggccgcgggtacggttgattttaagggcacggactttgaatacacgccgtttggggcgggccggaggatgtgccccggcatggcgtttgcgcaggcaagcatggagctcgtgcttgcagcgctcctgtaccatttcgactggaagctgcctggtgggatgctgccgagtgaattggacatggcggaggagatgggcatcactgcccgaaggaagcgcgacctttacctgcatccagtcgttgtcagtgtgccaccacatgtctca

SEQ ID NO: 5725 - DNA, 945 bp, Zea mays
atggcgcaggagatcgagcacacccacctccccatccgcggcctcaacctccacgtcgcacaagtaggcacaggtgaactgggcacggtggtgttcctgcacggcttcccggagatatggtactcgtggcgccaccagatgcgggccgtggccgcggcggggtaccgcgccatcgcgccggactgccgcgggtacggcctgtcggagcagccgccggagcacgaggaggtctctcctgacgacctcatcgccgacgtgctgggcatcctcgacgccctcagcgtcccgaaggcgttcttggtgggcaaggacttcggcgccatgccggcgtacgagttcgcgctgcagcacccgggccgcaccctcggcgtggtgtgcctgggcatccccttcaacccggctcccatgtccttcgacgccatcatgcccgaaggattctacatcctgcgctggcgcgagccgggcagggcggaggccgacttcggccggttcgacgtgaggcgcgtggtgcgcaccatctacgtgctcttcgccggcgccgagatcccgattgccaaggaagggcaggagatcatggacctggccgacctgtccacgcccctcccggagtggttcaccgaggaggacctggacgcctacgccaagctctacgagaagtccggcttcgggtacccgctcaagatgccgtacagatctatgcacaagctcccgaaccggctggacgccaagttccaggtgccggtgttcatggtgatgggggagaaggactacgcgttcaagttcccggggttcgagaccgccatgcgcggcggcgtcatggacaacttcatgccggacctcaagatcacctacatccctgaggggagccacttcgtgcaggagcagctcccagagcaggtcaacgacctgctactcggcttcctcagggaccatccctccgccgca

SEQ ID NO: 5726 - DNA, 351 bp, Zea mays
atgggcaggatggagggcgtgtggggcaaggactgcacggagttccgccccgagagatggctcaacgaggacggaaccaagctccggtacgagccgtcctacaagttcatctccttcaacgccgggccgcggacgtgcctcggcaaggagatggcgttcgtgcagatgaaggccgtggcagcggccgtgctgtggaacttcgccgtcgaggtggtaccgggacacgtggtggagccgaagctgtccatcatacttcacatgaagaatgggcttgccgtcaaggtgaggagaagggacgggacgtacggcgccgcgccgccgtcgagcgtcacgccttgcttttctgagttc

SEQ ID NO: 5727 - DNA, 492 bp, Zea mays
atgcccccgccggcagctaccggccggtgtgcgacacggtggtgttcgtctgcctcgcgtccgcctccgccctcatcgtgttcatggtggccgtctgcttccgcaacgccttcgccgccaacgggtacgcgaccgctgccgtggccacaaacggtgccgccggagccaccgctgccaacggcagaagccggtgcgggctggcgccgtccgcgctgtcggcgatccccgtgctcgcttaccgccggaggggcgccgggtgggcgcagtgcgcgatctgcctcgccttggtgcgggacggggagacggtgcgattgctgccggcgtgcggccacctattccacgtcgagtgcatcgacctgtggctgcgctctcacgcaacatgcccgctttgccggcgtggcgtcgtcgaggctcccgtcgaaaaggtttgaaagctcgccgctcttggccccaaaaaaaaaaaaagccaagatcacacgctggctgctatac

SEQ ID NO: 5728 - DNA, 381 bp, Zea mays
atgaagacactaaaggaaacaggtgccattgggaagcaaataaaagatggaattcgtttaatgggccgtggagcagaagaaatcaaatggcctattcaccttgaggtgtcaagggcaactgcaagggccaaagctgccgtggaagctgctggtgggacagtaaggctggtgtactacaacaaacttggattccgggcactcctgaaacctgagtggtttgagaagaagggccgcctgttaccaaaagcagcaaggcctccacccaagcagcgagataaggtcgatagcattggccgcctgcccgcgccgacaaagccactccccttcacggtagaggagctggagtttgcagcccagcgtgaggctgcccgcgtgactgca

SEQ ID NO: 5729 - DNA, 240 bp, Zea mays
atgccgccgaccttaacggttattgccgagcatgactggatgagggatcgagcaattgcttactctgaggaactccgcaaggttaatgttgactcgccggttcttgactacaaggatacagttcacgagtttgcaaccctggacgtattcctaaaaacaccacaggcgcaggcctgtgccgaggacattgccatatggatgaagaaatatatatccctcagagggcatgagttctcatat

SEQ ID NO: 5730 - DNA, 717 bp, Zea mays
atggcggccggcaccgtgacggcccgatccaacggcgagggccacggccacggcggcgcggggtcctggtacccgcagcgccgcccgcactacgggtacggcggggggtccgcctccttccgcggctgctgctgctgcctcttcctgctgctcaccttcctggcgctcctcgccctggccatcgcgctcgtcgtcgtgctcgtggtgaagccccgcaagccgcagttcgacctcgaccaggtgtccgtgcagtacctcctcgtggcctcgccgacgtccccggccggcctgccccccgcgaccccgggcgccgcctacatctccctcaacatcacgctgctcttcaccgcccagaaccccaacaaggtgggcatccggtacggcgccaccaagttcgacgtcatgtaccacggggtgccgctcggggtggcggcggtgcccgggttcgagcagcccgcgcacagcacccgcctgctccagacccgcgtcattgtcgaccgcttcaacgtgctccaggccgacgcgcaggacctcatccgcgacgccgcgatcaacgaccgcgtcgagctccgcatcaccggcgacgtcggcgcgaagatcctcgtgctcggcttctcctccccaaaagtgcaggtgtcggtggattgcgcaatcgccatcagcccgaggagccagtcgctgaaatacaagcagtgtggcgtggacgggataagcgtg

SEQ ID NO: 5731 - DNA, 780 bp, Zea mays
atggcgtcggagaagagcaagatcctggtggtcggcggcacggggtacctgggcaggcacgtcgtggcggcgagcgcgcggctgggccaccccacctcggcgctcgtcagggacacggcgccgtccgacccggccaaagcggcgctgctcaagaccttccaggacgccggtgtgacgctcctcaagggcgacctgtacgaccaggctagcctggtgagcgcggtgaagggcgcggacgtggtcatctccgtgctcggatcgatgcagatcgccgaccagagccggctcgtcgacgccatcaaggaggccggcaacgtcaagaggttcttcccgtcggagttcggcctggacgtggaccgcacgggcatcgtggagccggccaagtccatcctaggcgccaaggtgggcatccgccgcgccaccgaggccgcgggcataccctacacctacgccgtggccggcttcttcgcggggcttcgcgctccccaacatcgggcagctcctcgcccccggcccgcccgcggacaaggcggtcgtcctcggcgacggcgacaccaaggcggtggttcgtggaggagggcgacatcgccacgtacacggtgctggcggccgacgacccgcgcgcggagaacaaggtgctgtacatcaagccgccggccaacacgctgtcgcacaacgagctgctgtcgctgtgggagaagaagaccggcaagacgttccggcgggagtacgtgccggaggaagccgtgctcaagcagatccaagagtcgccgttccctc

SEQ ID NO: 5732 - DNA, 447 bp, Zea mays
atgatcatctgccaggtcgcggtcgcgtggatcatggggtcccagatcggggccgacggcgggtccgcgatggccaggccctactccctcgcggtgctggcgctgacgtgcgtcttctcggcggcgttcggctggtcgtggggcccgctgacctgggtgatccctggcgagatattccccgtggagatccggtcggcggggcagggcgtcagcgtggccgtcaacctgggcgccacgttcctgctcacgcagacgttcctctccatgctgtgcacgctcaagtacgccaccttcatctactacgcggcctgggtagccgtcatgaccgccttcgtcgtggcgttcctgccggagaccaagggggtaccgctcgaggccatgggcgccatctgggagcgccactggtactggagacggttcgtgcagccttctgttgcggaggacccc

SEQ ID NO: 5733 - DNA, 573 bp, Zea mays
atgggcgtccttcctcggcatcgtgctagccaccgtgatgcttctgaaagccctcaccggccgccgcagccgccgcatgtacaacctcccgcctggccccaagccgtggccgatcatcggcaacctcgacctcgtgggcgcgctcccgcaccgctccatccacgagttgtccaggaagtacggcccgctgatgcagctccggttcgggtcgttccccgtggtggtcggctcgtcggtggacatggccaagttcttcctcaagacccacgacgtggtgttcacggaccggccaaagacggccgccggcaagtacaccacctacaactaccgcgacatcacatggtccccctacggcgcgtactggcggcaggcgcgcaagatgtgcctcaccgagctcttcagcgccaagcggctcgagtcgtacgagtacatccgcgccgacgaggtgcgcgcgctgctgcgcgacctgcacgcggcgtccagctccggccgcgcagtcatgctcaaggactacctgtccacggtgagcctgaacgtgatcacgcgcatggtgctcggcaagaagtacctgga

SEQ ID NO: 5734 - DNA, 567 bp, Zea mays
  misc_feature (248)..(248): n = any nucleotide
atgccgaggatgcgcgcgctgggctggtggacggtcatgatgacgacgctgccgctgcgcgcgatgcggcggagcacctgcaccaccatgaacgcgctggcggagtcgaggcccgacgtgggctcgtcgaggaacagcaggatggggtcgtggatgatgtcggtgccgatggacacgcggtggcgctccccgcccgacaccccgcggcgggcctcgtcgccgatgatggtgtcggcggcgcgggccancccgagctggtcgacgagcgcgtcgacgcgcgcgcgcttgcggtcggcgggcagcgcgcgcgggaggcggcactctgcggcgatccgcagcgtctcgcgcaccgtcagcatcgggtggactatgtcgtcctgcaccacgtgcgctgccatgccgtgcgttggactggccgtggccctgtatggttggtgtttgtgtgcgcgcctcgcctgtttagtcaccgtaggtattggtttagggagtggatgtgcgtttttgggttatttggtgtatatgctacccatccctttctgcacgtgtggggtgtgtctgcggtgcctg

SEQ ID NO: 5735 - DNA, 477 bp, Zea mays
atgcaacccgtttgccgctcgtgcttggcccccgcgcggccacagccggaggtaccccgcgcgcgcgcggccacggcgtgccaggcccgggccaccacgacgagccgcgtctgcgtctggcgcgcggctcccgcgcggcgcttgcgcgcaaacacgccgcgcggaggcgggacgacggagcccgtcgagccgcgcaaggacgggccggcgtcggcggtcgatcaggcggaggaggccgggctggcgcccgaagagctggaggtgctggaggaggcggccatcatgggggaggacgaggggcgccggcccaccgactacgaccgccgcgcgcacatcttcgaggagagctcgcgggtcttccgtgatctcaagcagcgaagcgacggcgacggtggcggcggaagcgagagccagagcggccgtggtggtgccgtgactactggtgccgcggcggaaacagctaacaagaacgcggtg

SEQ ID NO: 5736 - DNA, 348 bp, Zea mays
atgaataatgttaagcttcactttacagatggtgcacttagaataattgccaaaaaggcaatgtcaaaaaatacaggtgcacggggtttaagaactatccttgagaatattctcatggattctatgtatgagatcccagatgcaaaatctggggagaagcgaatcgatgcagtggttgtagatgaagatgcagtaggatcagtggaccaacctggctgcggagctaagattctttacggtgatggtgctttggatcaatatctatcccagataaaggtgtcaggagacggagtggggagcgaaatggatggggaagctgagctttcgtcatcgagagccattggcatg

SEQ ID NO: 5737 - DNA, 393 bp, Zea mays
atggtggtgaagatgtgggcgccgcaggtggaggtgctgcggcacgcagccacgggcgcgttcatgacccactgcgggtggaactcggtgctggaggcggcgtcggccggcgtccccatgctgtgctggccgatgtacgccgagcagagggtgaacaaggtgttcgtagtggacgagatcaaggccggggtggtgatggacggctacgacgaggagctggtgagcgcggcggaggtggagaagaaggtgaggctggtgatggagtctgaggaaggggagaagctcagggagaggctggcgttggcaaaggagaaggcggcagaggcgctggctgatggcgggccgtcgcggatggcgtttgaggagttcttgaaggatatcatgctcgccaaa

SEQ ID NO: 5738 - DNA, 774 bp, Zea mays
atggctgctgcatcatcatgccaggcggtgtcagcgtcgagagccccgaagtcggcgtactgtccagtaatggcagcaagctccggcgacggccatggagtaagctgctccatctcagcgcgagccgccgcctccgacctggcgagctccaccagctggcggatgacctcgtcagccagctcgccgccggagctccggctctccaagcggagcgtctggggctcctcccacgcggagccggcgcccaggatggtcgcgagatcggcgaccgaggggcacccggcgtacccttccaccgcgccaccgtcgtcgctactactgtcggcggcgccaccgccgtcccgctcatccttctcctcccccaagcggcagcctggcgcacaggaagccgccgcgcgtggcgggccgcagcggcagcggcctgcgcggcacccggcgcagagcggcgcccgggcgtggcgagtgaacacggtgttggcgccgtgcacgtggcggtcgcacggcaggcacagcctcgcggagtcggcccggcagtacaccaccgccggcatgcccgtgcaggagtcgcacgccggcgccgcctccttgccgccggctgcgtccgcggcggacatggcttccacctgcgacaagacaagacccggggaggatctggcaccgcacaggattgatggtgcgaggcgacgatggaggcgtacaggtagtacagcctcgcacgatctccaccgtcgcccgtcgctactactgggcgacaggcctgacggcctctatgag

SEQ ID NO: 5739 - DNA, 339 bp, Zea mays
atgcatggcgtaacgtctcccctcctcatggttctcaagcacaccagctgccctccctgccttgtttaccctgacttccgggttgccagtgatgttccggaagagctgaaacccgcagatgccgacggccacgcccgtcgccgcgaacagcgggtacacctcgggccggacccagcggctggccatctgagtcggagtctcttcgcactgggacgcggcctcgacggcggagaagcacggggaaagtggacaggcgacggcagagggggagtgggcggagtgggtggagcggttttatcggcgtgtgcggtgtggtcgtttggagcttctcgcccgaaa

SEQ ID NO: 5740 - DNA, 225 bp, Zea mays
atgtttttgagaagcctggtgttgacaacgactggcttcccgacagtcagcgttcctgtcttatcaaagacgatgcagtttaccttttgtgcactctcaagagcttgtccacccttgatcagaacgccttgtgacgcaccaactccagttgcaaccatcacggcagttggagttgccagccctaaggcacaaggacaggcaatcaccataactgatattccaaac

SEQ ID NO: 5741 - DNA, 498 bp, Zea mays
atgagcaggatctcgttgagcgtgccggacatgttggcgacgctggccgggaggcagccgccgaaggcgttgtgcgcgaggacgacgacggacgccggcgagttgccgaagttgtccgggagctggaagcggaggcggttgtggttgaggaagatggcgtcgagcgggcggtcgaagaggcgcggcgggacggcgccctcgaagtcgttgaagcggaggtccaggaagcgcagcgccgggaggtccaggacgacgtccgggaacttgccgacgaagcggttgttgctgaggtcgagctcgtggaggaggcggaggcggcggagcgcgcgggggaggacgccgcagaagcggttggagttgaggtggagcagggcgaggtcggcgaggaggccgagctccggcgggaggaagcccgcgatgtcgccgtggttgaggtcgaccccggcgacggcgagcgcgccgcggcggtgggtgccgccggaggggagcggcgcgcag

SEQ ID NO: 5742 - DNA, 474 bp, Zea mays
atggcgtcgagcttccgcagcgcggggatgttcatggcgaggtcgcgccgctgcgccgtggacatgatctccatcgtgattccgttctccgaggtgtggcgcgtgggcacgaactcgacgatgtggtcggtgacggagagcagccatcccacctccctcttccagcgctccttggtgtcgggcgccatgggctccagcttgcggtgctcgccaaagacggacgccgcgaggttggtgacggcgttggacagcgcgagcgcggacggcacgcccttgccggtgccggacatgtcctcgcccagcaggagcttggcgaacttctccttcatcacgtccagctctgagagcggcccgtcgcggccctggcgcaaccgcgccgccccggccgctgccgcctggctgttggcaaggggcggggtgccgccggcgccattgctatacatctcgcccgtgtcgctgccgctcctgtcgagg

SEQ ID NO: 5743 - DNA, 282 bp, Zea mays
atgcggccaaagagaagggcggcggcgatgcagagaagaagaaggccgacaagaagaagggaggcggtgatggaggagagaaaaatgccgacaagaagaagggcggcggcggcggcgataagaaggccgacaaggagaagggcactggcaaacccaaggaggaagaggaggaggaggagaagcccaaggaacccaaggaggagacggttacgctcaagatccaactgcactgcgacggctgcatggaccgcatcaagcgccgcatctgcaagatcaaaggtg

SEQ ID NO: 5744 - DNA, 546 bp, Zea mays
atgtcgctggctcgttacgacgccaacgtcctgctggccgcggtgaccgcgctctcggcggctgtcgctttcgtcgcggcgcttcacctctacgcgcggtgcctcctgcagcggcgcgtcgccctcgcggaaggcagccctcgcgtggtcgcgctgcagcggcagcgcccgccggacggctacgtggtggaggtcgtccgcatcgtcgaagacgcaagcgtgtgcggccagcaggctgcggggctggacgccaaggcgctgcgcgcgctgccggtgttcacgttggagtccgagcaggccaaggaagaaggcggcgtcgctgccgagctgcacgggcagtgcgtggtgtgcctcggggagatggaggatggcgagctggggaggctgctcccggggtgccgccacgtgttccacgttgagtgcatcgacacgtggctcggggtgagctcgacctgcccggtgtgccggacggcagctacgcctgccgctccgtcggccgtcggcgtggaccacggtggcggggaagagtccatagctgttgagtgc

SEQ ID NO: 5745 - DNA, 672 bp, Zea mays
  misc_feature (527)..(527): n = any nucleotide
atgaagaaggccacttcgctctccgagctgggcttcgacgccggcgacgcgtcgtcgggcttcttccgccctgtgtccggcgactcgtcgacgccgacgtcgcagcaccaccggcggaggctgaccaaggtgtcggtcatcggcgcgggcaacgtggggatggccatcgcgcagaccatcctcacgcgcgacctggccgacgagatcgcgctggtggacgcggtcccggacaagctccgcggggagatgctggacctgcagcacgcggcggcgttcctgccgcgcacgcgcctcgtgtccggcaccgacatgtccgtgaccaggggctcggacctggtcatcgtgacggccggggcgcggcagatccagggcgagacgaggctcgacctgctccagcggaacgtggcgctgttccgcaagatcgtgccgccgctggcggagcagtcccacgacgcgctgctgctcgtcgtgtccaaccccgtggacgtgctcacctacgtcgcctggaagctttcgggcttcccggncagccgcgtcatcggatccggcaccaacctcgactcgtccagttcaggttccttctcgccgagcacctcgacgtcaacgcccaggacgtacaggcgtacatggtcggcgagcacggcgacagctcggtggcggtgtggtcgagcg

SEQ ID NO: 5746 - DNA, 981 bp, Zea mays
atgactgactcgatcgaatacgttggaacgaatacaaatgatagaatattgatttatcataaacagagttacactatattaaagattccaaagtactttttagtgttagatctggaaggagatggtgctgttgggcgggttgtaaaactggacggtcctgccgttgagcggctgcgtggggcgcgcgtcgctcccgggcagcggcgccttgagcagctgcagctggtcctggctgatctggcgcaccttgccgaggacgctccagacgacgttctcggtgcatggcggcacggtgagggagcccgtgtagcggaagtagctgccggtgcgcttctgcagcgagcgcaggtggatgaggccggcctccacccgcgactcctcctcctcggcgaagtcgcaccggtcctgggccatctcgcccagctgccgcttcagctggtagtagaaggagtccggggcgcccagctggtagaggatcccgatgaccgccagcgcgccgtcggcgctcctgtggaccaggtgcagctccagcgggaacctctggccgttgatggtgtggtcggagggcgagtgccagtgcagcttctcgaagctgtacgccttgccgttcaccgtcaccgtcccaaccttgccctcgagcgccagcgtgatgtcgtggccgtcgttgatgagcgtggcgttggtggcgccgtaggtgcggttgagggtgtcgagggtggcggcggggacggcctgcttggtgacgatgtcgatcggcgactgctgcttcccctccccgcacagcttgtacgcggggctcagcttcccccagttctccggcccgttggggctccccgccgcgtacccgtacaccggcgccgccatcccgccgccatccgagagcgcgacggcgagggaggccgcggcgacgaggaggccgatgagcgcacgggcggaggacaccattgccggcgtgcacggatgagcacacgcactggtaga

SEQ ID NO: 5747 - DNA, 102 bp, Zea mays
atggccctccgccggcgctcccggcgcttgttgttctcccgctccttccacgtcggcgtccgccccagacctcccgccgccgccgccccggacgtcatggtc

SEQ ID NO: 5748 - DNA, 498 bp, Zea mays
atgaaacgtgatgcaccaataattgcggagtatttaggaggtgctgtgaactgtgatgcttaccatatgactgatccgagatctgatggtcttggtgtttcatcttgcatcaagcaaagccttaaagatgctggtgtggcgcctgaggaggtcaactatattaatgctcatgcaacatcaacccttgctggtgatctggcagaggtgaatgccatcaagcaagtcttcaaggacccatctgggattaaaataaatgcaaccaagtccatgataggacattgccttggcgcagcaggcggtttggaagccattgctactattaaagcgataactactggatgggtgcatccaagcataaaccaatttaacccagaggaagcagttgaatttgacactgtacctaatgtaaaaaagcagcatgaagtgaatgttggtatctcaaattcctttggatttggaggtcacaattctgtcgtagtatttgcaccatttaagcca

SEQ ID NO: 5749 - DNA, 741 bp, Zea mays
atggcggcggcggcggcggcggcggagcaaggcgtggacgccgcgaggaaagaggaggaggaggagcaggtagtgaatccgtgggaggtgtcggcggggaagggcggcatcgactacgacaagctcgtggaccagttcggctgccagcgcatcgacgacgcgctcgtggaccgcatcgcacgcctcaccgcccgaccaccgcactgcttcctccgccgaggcctcttcttcgcccaccgtgatttgaacgagatactggatttgtatgagaacgggcagaagttctacctctacacggggagggggccctcgtcggaggccctgcacctcggccacctcatccccttcatgttcacaaaatacttgcaggaggcttttaaggtgcccctagttatacaactgactgacgatgagaagtacttgtggaaaaacttgactattcaggaaagtaaaaggcttgcccgtgaaaatgctaaagatattatagcatgtggttttgacattgaaagaacattcattttctctgatttttcttttgttggaggtgctttttatgaaaacatgatgcaagttgccagatgtgtaactatgaataaggctattggaatatttgggttcaatcttgaggatcacataggaaaagttagcttttctccagtgcaggcaggtccatcattccctttctcattttcccatctcttcgctggcagggacaactgcggtgtcctatccccatgtgca

SEQ ID NO: 5750 - DNA, 390 bp, Zea mays
  misc_feature (95)..(95): n = any nucleotide
atggcagaagatgcagctgagacccttttgttttcaaagacaactactgcaaaggtgtggttaattggagatggtctagatgcttctgagcagtntaaggcacagaaagggacccagtttatcccatattcacagtttccaccaagaatggcacgcaaggacacctgcacctactcgacaactcctgcaatggttgtacctaaaacactacagaatgtgcactcctgtgagaattggctgccaaggagggtcatgagtgcatggcgcattgctggaatggttcatgcattggagggatggaacgagcatgagtgtggggacatcgtgctagacatggagaaaatgtggtctggtgctcttctgcatggtttccgccctgtggctcaagtt

SEQ ID NO: 5751 - DNA, 699 bp, Zea mays
atgctgccacagacacacgcgcacaacattcagaagaacgcaaacatgccctctgctagctcggttgttgcttattggcgattgatctgttctaactcagcggtccaacgagctgatcaccacccagtcgtagacggtggggctcctgggcccgacggccggctccggcccgtcggagaccttggttttccggcggaacctcctccagacgtccgccttgggcggggtagctgcggcgagcggcgagtcgggcgtgctggccggggaggacgggacggaggaggagctgtaggactcgacggagagcgacggcgggcgggcgatggtgatgctgcgcgtcaccgccggcgccggcgccggcgcgggagccaggatggacgacgacgaggaggaggagggggagaaggaggagtacttgcggagcttgccgaggccggagtccggtcgcgggccggccaccgtctcgtcccagagctgatcgaggaggcccattccggccaccaccagacccggacggacgcgattggttggctggcccctgcgtgccttggacgacgtatgcgctgcgcgcgcgtcgcgttgtcttgtcacgtcgcggcgagtgagggacggacgagagagaagagaagacgggcttgggttggcccggctgccgtgccgtgccgtgcctggatctggagcagttgtgggtggggcgga

SEQ ID NO: 5752 - DNA, 915 bp, Zea mays
atgtggtggtccaagttccacaagaaccagctcaagtacacgcgcggctacctcatcgagctgatgcactcggacaccatctacatctccaacctgacgctgctcaactcgccggcgtggaacatccacccagtctacagcagcaacatcgtggtgcaaggcatcaccatcctggcgccgaccaactcgcccaacaccgacggcatcaacccagactcctgctctcacgtccgcatcgaggactgctacatcgtgtcgggcgacgactgcgtggccatcaagagcggctgggacgagtacggcatctcgtacgggatgcccagccagcacatcgtcatccgccgcctcacgtgcgtgtccccgaccagcgccgtcatcgcgctgggcagcgagatgtcgggcggcatccaggacgtgcgcgccgaggacatcacggcgatcaacaccgagtccgccgtgcgcatcaagaccgccgtcggccgcggcgcctacgtcagggacgtgttcgcgcgccggatgacgctcaccaccatgaagcgggtgttctggatgacgggcgactacaagtcccacccggacgacaagtacgaccccaacgccgtccccgttgtcgccaacatcagctaccaggacgtggtggccacgggggtctacaaggaggcggcgcgcctccagggcatccagggcgcaccgttccggggcatctgcgtcgccaacgtcaccgccgacctgtccaagtccaggaagtacccatggaactgcgccgacatcgagggagtgtcggccaacgtcagccccgcgccgtgcgacccgctacagggcgcgcacgacggcgcatgcccgttcccgaccgacacgctgcccatcgaccaggtcacagtgcagcagtgcgcatacgacatcccggccaccaac

SEQ ID NO: 5753 - DNA, 1014 bp, Zea mays
atggacctcttccgcaagtgcatggagcccgtggagaaatgcctccgcgatgccaagatggacaagagcaccgtgcacgacgtggtgctcgtgggcggctccacgcgcatccccaaggtgcagcagctgctccaggacttcttcaacggcaaggagctctgcaagagcatcaaccctgacgaggccgtggcgtacggtgctgctgtccaggccgccatcctgagcggcgagggcaacgagaaggtgcaggacctgctccttctggacgtcaccccgctgtccctgggcctggagactgccggcggcgtgatgaccgtgctgatccctcgcaacaccaccataccaacgaagaaggagcaggtgttctccacctactccgacaaccagccgggggtgctgatccaggtgtacgagggagagcgcgccaggaccaaggacaacaacctccttggcaagttcgagctgtccggcatcccgccggcgcctcgcggcgtgccccagatcaccgtgtgcttcgacatcgacgccaacggcattctgaacgtatcagcggaggacaagactacaggacagaaaaacaagatcaccatcaccaacgacaaggggcggctgagcaaggaggagatcgagaagatggtgaaggaggcggagaagtacaaggcggaggacgaggagcataagaagaaggtggacgccaagaactcgctggagaactacgcgtacaacatgcgcaacaccatcaaggacgacaagatcgcctccaagctaggtgcggatgacaagaagcgcatcgagaacgccgtggacggtgccatcagctggctggacagcaaccagctcgcggaggtggacgagttcgaggacaagatgaaggagctggagggcatctgcaaccccatcatcgccaagatgtaccagggcgctggcgcggacatgggtgctgctgccggcatggacgaggacgcaccggccgccggcggcagcgccgctggccccaagatcgaggaggtcgac

SEQ ID NO: 5754 - DNA, 366 bp, Zea mays
atggcgtccgagcagggagtcgtgatcgcgtgccacagcaaggctgagttcgacgcccacatgaccaaggcccaggaagccggcaagctggtggtcatcgacttcactgccgcctggtgcggtccatgccgcgccatcgccccactgttcgtcgaacacgccaagaagttcactcaggtcgtcttcctgaaggtggacgtggacgaagtgaaggaagtcaccgcggcctacgaggtcgaggcgatgccgaccttccacttcgtcaagaacggcaagacggtcgcgaccatcgtgggtgccaggaaggacgagctcctggcccagatcgagaagcatgccgcgcctgcgcctgcgtctgcgtctgcc

SEQ ID NO: 5755 - DNA, 390 bp, Zea mays
atggcggctcagggaagtggcagtgctcgtggcagcggcgccgccgccgcgcttgcgctggtcctcctctgcgtgctcctccacggcgagttggccgagtcggcggtgtacacggtcggcgaccgcggcgggtggagcttcaacaccgccaactggcccaagggcaagcggttccgcgccggcgacgtgctcgcgttcaggtacaacgccaaggcgcacaacgtggtgcccgtgagcgcggcggggtacaagtcctgcagcgcgcccaagggcgtgagggcgctcaccaccgggaacgaccgcgtcacgctgaagcgcggcgccaactacttcatctgcagcttcccaggccactgccaggccggcatgaagatcgctgtcaccgccgcg

SEQ ID NO: 5756 - DNA, 996 bp, Zea mays
atgatgaggctgaagcagcacatgggcctggtctcctcccctacccctgccatcgtcgtgaggctcggcaacaacacaccccaccgccgccgagcaactcggtctcggatcgtgtcgtcctccgcctccgacgccgcgccgttcgagaagcccagggccgtggtcaagaaggtcctcgcgcagtcgcagcccgagggtcagggtgccaccgtccgtaggagcatcggcaggcacgagctccgcaacctggacccgttcctccagctcgacgagttcacagtctccaagcccgccgggtttcccgaccacccgcacagaggattcgagaccgtcacccacatgtttgagggggccatcacccaccaggacttcgctggtcacaagggcaccatcaggacaggggacgtgcagtggatgacggcggggcgaggcatcgtgcactcggagatgccggctggggacggcgtgagcgagggcctgcagctctggatcaacctctcctccaaggacaagatgatcgagccgcgataccaggagctggagcgcaaggacatcagccgcgcggagaccgaggacggcgtggaggcccgcgtcatcggccggggagggccttcgcgcgtggcgtcccccgtgtacacgcgcactcccatcatgtacgtggacttcaccatgcgacctgggtcccgcctgcaccagcctgtcccggagggctggaacgccttcgtctacgtcgtcgacggcgagggcgtattcggacgggagacggccacggcacaccactgcctcgtcctcggctccggcgacggcgtcagcgtgtggaacaggtccgccaggccgttaaggttcgtcctcgccgccgggcagccgctcggtgagcccgtggtgcagcacggacccttcgtcatgaactcgcacgccgagatacagcaggccatggaagactactcctacggcaagaacggcttcgagagggccggccagtggagctcctccgcc

SEQ ID NO: 5757 - DNA, 378 bp, Zea mays
atgtactgcaggatgatctgggactcgtttacggggcgacccgcgtggagcagcacgggcacggtcttgtgcaccgggttggagctgagcaggagcgcgctcttgttgctgaggtcgtcctccacgtactcgtacgccaggcccttgaggttgagcacgatgcggactcggatcacaaacgggctcgtccacaggcccagcaccttcaggtcgtcggctcccgccattgccagcgctctctctctctctctctctctctcgtccacagtccaatgggctttatatatagatagatatagatgtgagcagtgtctggtgacctgttttgttttgtttttttctctctctccagatttgtgcatctgtacttggccgtct

SEQ ID NO: 5758 - DNA, 576 bp, Zea mays
atgaagttgattgactttggtctgtcagattttattagaccagatgaaaggctcaatgatattgttggaagtgcttattatgttgctccagaggttctacacagatcatacagtatggaagcagacatttggagtataggtgttataacatacattctgctctgtggcagtcggccattctgggcaaggacagaatctgggatcttccggtccgtattgagggctgatcccaattttgacgattcaccatggccttcagtatcggctgaggctaaggattttgtgaagagatttctgaacaaagattaccgcaaaagaatgactgctgtccaagcactgactcacccttggttacgagatgaacaaaggcaaattccattggacatactcattttcagattagttaagcagtatctccgtgctactcctcttaaacgtttggcattaaaggcactatctaaggctttaagcgaggatgaacttttgtatcttaggttgcagtttaagctgcttgaaccccagagatgggttcgtgtcactcgacaactttcgggcggctctgacaagatactcaac

SEQ ID NO: 5759 - DNA, 708 bp, Zea mays
  misc_feature (248)..(248): n = any nucleotide
atgcacttcccctcgccgcgcgcgctcgccatggccgcgccggcggtcgcccgccctcgcctcgcccccgtggctcaccccgcctcgacctcttgcctgctggccctctgggaccggaggcgcgggcacggccgcgcggttgcggcggtgagggcgcgcgagcaaggcacggcgccgcccgacccggcggccttcctgcgccggccggaggtagcgacggtgacgtcgacggaggaggagagggaggncgatgcggggtcctcgtttgatggccccggggaggacgaggcgcccgaggaggaaggggttccgggggaggaggaaggcgccggagagggagtggggtgggattggaaggaccttatcctggaggacaccgtgccgctcgttggcttcgtacgaatgatcctccgctccggcaagtatgaaagtggcgatcggctgtgtcctgaacatgagaaggcgattttggaacgtttgcttccataccatccacaatataatgagaaaattgggtgtggtattgactacatcacggtagggttacatccagaattcgaaaactcaaggtgtttattcatagttaggaaggatggcgagcagatcgatttttcgttctggaagtgcgtcaaaggtctcattcggcaaaagtaccccatgtacgcggacagtttcattctcaggcatttccgcaggagacaagactac

SEQ ID NO: 5760 - DNA, 642 bp, Zea mays
atggcgaggatccacctctacgtcgtcgccgcggcctgcgccgtcgccctcgcgctcgccggcgacccggacatgctccaggacgtctgcgtggctgactacgcttccccggtcaagctgaacgggttcccgtgcaaggcgaacgtctcggcggacgacttcttcttcgacgggctgaggagcccgggcaacaccaacaacccggcgggctccgcggtgacggcggccaacgtggacaagttcccgggggtgaacacgctgggcgtctccatggcgcgcatcgactacgcgccgggcggccagaacccgccgcacacgcacccgcgcgccaccgagatcatcttcgtcctcgagggcacgctcgaggtcggcttcctcaccaccgccaacaggctcctcagcaagaccgtcgccacgggggacgtcttcgtcttcccccgcggcctcgtccacttccagcagaacagggggcacggccccgccgccgtcgtcgccgccttcaacagccagctccagggcacgcaggccatcgccatgacgctcttcggggccacgccgcccgtgcccaccgacatcctcgccaaggcattccgggtcggcagcggggaggtcgagcacatcaaggcaaacttcgcacccaag

SEQ ID NO: 5761 - DNA, 348 bp, Zea mays
atggtatttgcaaagtcaaaatctgaagaaagcatggatcagtggtctgaaataccttcagatgtggaatccttcagagaaggtaaaaggtacctcagtagcgaggagctgagtgacgttgatagtgccaacgttgttgtcatggacaaatacatggattcactcctctctgaccggaggaaccttccctacgctagctcctcggtgcgccgggattcagtcagacgaaaacctgcttcgtccgccgattacagccgccgacctccgcagccaactccacctgcatcgctgtcaaagaaggaatcgtgggatgtcattgaagattcggagttcgatatacttgacagt

SEQ ID NO: 5762 - DNA, 414 bp, Zea mays
atggcgagcgagggagccccctccggctccgtgagcctgggcgcgctggagtacatccatgtgcacaagactgcgcggctcgtggaggccgcggccgtgtcgggcgccgtcgtcgggggcgggggcgacggcgaggtcgagcgcgtccgtcggtacgcgcacttcttagggctcctgggccaggtggtggacgacgttctggacgtgacgggcacgtcggagcagctcgggaagacggcgggcaaggacgttgccgccggcaaggccacgtacccacggctgatgggcttaaagggagcgcgcgcatacatgggcgagctcctggcgaaggccgaggcggagctcgacgggttggacgccgcgcgcacggcgccgctgcggcacctcgcgcggttcatggcgcacagacagcat

SEQ ID NO: 5763 - DNA, 303 bp, Zea mays
atgtccgccaccgccgtcgtgtccatcctgcagggcgccgccgccgtgctcgccttctcccgcacctcggagttcctcgccggcgggctccggtcgtacgtccgcgaggaggacggcgccgtcatcctccgcatggtcggcgggctcggcgtcgccatcttctgcctcgagtgggtcgcgctcgcgctcgccttcgtgctcaggtactacgcctacgtcgacagggagtgcggcggcaacccgcagcgccgcagcgccaaggtcggcggcgaggacggcgccggcacctggcccttccaggtc

SEQ ID NO: 5764 - DNA, 384 bp, Zea mays
atgtaccgcattaatgatgacctggaatactctgttgagatctatgaatggtccggaacaagctggaagccgtatgttgctgatgatgtgcagcttcaatttttcatgatgagcccttacgttctgaaaactatgtcgactgacaacaagggtttgtattcaacaaccttcaaagttccagatgtttatggagttttccagttcaaagttgagtaccaaagactgggatatactggtctgtcttttacaaagcagattccagtacgtccttacagacataatgagtatgagagattcataacatcagcgtacccatactacaccgcctcattttcaacaatgggtgctttcttcgtattctcgtttgtgtacctgtaccacaaa

SEQ ID NO: 5765 - DNA, 690 bp, Zea mays
atgcgccacctccccaagcaccccaacatcgtcacgctcagggatacctacgaggacgacaatgccgtgcacctcgtcatggagctctgtgagggtggggagctcttcgaccgcatcgtggcgcgggggcactacacggaacgcgctgccgccttggtcacacgcactatcgtcgaggtcgtgcagatgtgccataagcatggagtgatgcacagggatctcaaaccagaaaatttcttgtttgcgaacaaaaaagaatcagcagcccttaaggccattgattttggcctgtctgtatttttcactccaggcgaacggtttacagagattgttgggagtccttattacatggccccagaggtactaaagagaaattatggcccagaggttgatgtttggagtgcaggggtgattctgtacattcttctctgtggtgtccctccattctgggcagaatcggagcaaggtgttgctcaggcaattatccgatctgtcattgatttcaaaagagatccatgggcaagggtctctgataatgccaaagaccttgtaagaggaatgctcaacccagatccaaagcgacgattgacagctcagcaagtgcttgatcacccatggttacagaacattaagagggctccaaatgtcaatttgggcgaaactgttaaggccagacttcaacattctctg

SEQ ID NO: 5766 - DNA, 867 bp, Zea mays
atggcaaccgtgttcctccgttccctcgccatggccatggccgacaccgcgctcccgccctcccacaagctcctccctacggtttccctgccgctcctcccctcgtccacccgcgccgcgccgctcctcctctgcgccagccgccgcctgccgcccgcgcccctcgttgcctcatccgacgccgtcgagacgaacattgaatgggtcgacgacgacgaggaggaggctggagaagccttcgacgaggagggtggggatgttgaggaggaggtgctggcctcaggcgacgagggtgagggggagtacgccgcggtggagccgcccgaggaggcaaaggtctacgttgggaacctcccctacgacatcgaaagcgagggactcgcgcagctcttcgaccaggccggcgtcgtcgaggtcgccgaggttatttacaacaaagagactggccagagccgtgggtttggctttgttaccatgagcactattgaggaagctgataaagccattgagatgttcaaccgctatgacattagtgggaggcttctgaatgtaaacagggcatctcctaggggcactcgcatggaaaggcctccgagacaatttgcgcctgctttcagagcttatgttggcaacttgccatggcaagctgatgactctaggctggtgcaattgttcagcgagtacggagaagtcgttaatgctgcggttgtctatgatagagaaaccgggcgctcacgaggattcggttttgtaacgatggtgtcgaaggaggaactcgacgacgctatctctgccctggatggacaggaattggacggccgccctcttcgggtgaacgttgcagcagagcgaccacagaggggcttt

SEQ ID NO: 5767 - DNA, 504 bp, Zea mays
atgccccagatcgaggttacctttgacattgatgccaatggcattgtaaaggtgtcagctagggacaaagccacaggcaaagaacaagaaatcaccatcaagtcttctggtggtttgtcagaggtcgaaattgagaagatggtgaaggaggccgagctacattctcagaaggaccaggaaaggaagtctcttattgatctcaagaactctgcagataccacgatctacagcattgagaagagtgtcagcgagtacaaggacaaggtccctgctgaagtcaccaaggagatcgagtctgctgtctctgatctgagggcagctatggctgaggacgatctggacaagatcaagcagaagctggaagcagcaaacaaggctgtttcaaagattggagagcacatgcaacaaggtggcggcagcggcagcgctggcggcagcggcagcagcagtggaggagaccagactccagaagctgagtaccaggacgcaaaggaagccaagatg

SEQ ID NO: 5768 - DNA, 387 bp, Zea mays
atgagtttcctgttcgggaagcggaagacgcccgccgagctgttaagagaaaacaagagaatgctggatcgatccatcagggaaattgagcgagagaggcaaggattgcaggcccaggagaaaaagctcatcactgagatcaagaaaacagctaaagaaggtcagatgggagctgtcaaagtaatggccaaagaccttattcgtacccggcatcagataacaaagttctaccaactcaaatctcaggtccaaggagtttctctaagaggtcagacactaaaatcaactcaagctatgggtgatgccatgaagggcgttaccaaaggcaatggctcaaatgaacaggcagctacatctgccagggttgcagaggataatgccacagtt

SEQ ID NO: 5769 - DNA, 561 bp, Zea mays
atgggctgcatcggggggaaggacggctgccaggggcggagcatggggtcgtcggtgaccatctccgggatgtcgacggcggcgccggccatctggagcacctcgaggacgccgcccagcgactgcaggcggccggccagctcggcgtggcgggcgcgcagcaccgcgttgtcgccgtccaccctgcccaggtcgcgctccagcgccgcggtgcgggcctgcgtcgccgcgttctccgcctgcaggcgggccacctccgccaccagctcctccagccgctgctgcttccgcgcgcgcgaccgccgcgccgactccctgttggacagcatccgcttccgcttgcgctcgtccgtcgtgtcgttgctgtcggggctcgagctccggcgtgacgacgacatggatgcttgtcttgtcggattgaatctgtttggtggggggtggggtggggggaggatggggagaaacaggagccctagagatggattcgaaagactatctcagagagaaagagagagggagagacggcgaaggatcagcagttggagaggggcgatgcgttca

SEQ ID NO: 5770 - DNA, 162 bp, Zea mays
atgaaggccagcagtttctggtcctcctcggacgtccacggccccttcttcagcccggcctccttctcgcagcacggcgaccgccccatcgcagcgccgcgcgcggcgaccacaggagcgagaaggacggcagggacacgcagctcgcccagaggtagacga

SEQ ID NO: 5771 - DNA, 381 bp, Zea mays
  misc_feature (35)..(35): n = any nucleotide
atgtccaaaaaactgtttggttatcttgggctttntacccttgttgctctattggtggattgtctgcccattaaccgcactagggcgttgagcccaaagttttcaatgccccactcagctaaagtggatgaagtggtggtggcaaatagcctaatcggaagtgtattatcagactacttctgggctctttctgttgtttggactactcccttggtggccactctaggcatgtctctcacaattccaatagcaatggttgctgatatgatcattcacgcccgtcactattcagcagtatatattcttggttctgtccaggtattttcaggctttgttatcgcgaaccttgcagatcgcttttctcgttctctagggctatca

SEQ ID NO: 5772 - DNA, 831 bp, Zea mays
atgctgctgatgctacacgaaactcttcctttcgtgaggccgacgagttcttgccgggacccaaaactctccgagaagagtgcctctgctttccacggtaaattgggatgcagtgcggtctgcagttcagcggaaggctatcgtgtacagaagccgcacattgttcacagctacaaagttagcttcactaggaccagccatcatctgtgtaaaagcttaaacgagagaactacaaggcactgcctgcatcggttccatgttaatgcttcgcccgatgacgacgacttccgctcatcgcgtaacatagcgatcagtttgttcaagcggtacaagaatgtcattgaccgaggaggtggagaaaacctaaatgagtttgtcagtgctggagtgaccgcttacgcactagggtgtacagatgaggggcttagaaaggaacttatggatattgaagattctggtctggagattgaaggcttagggtccttggggggcaccagcctcaagttcaaagtccactcctttgagatccgtgagtgcatcctgtggctcagtatagtgttcgtcacaatactgtgcacaccacaactaacagttatcaggtggtctccgaacccaccggtgtcagccgacgtcttgcatcagtggaaaggattctgtgctctaatcgcgaacgcttactatgtcaaaggaatggcatggttgccagtgaaaaccttgcagctggaacagatggctgtcacaggaagttcagagaaaccatcagtagttgctagtcgcatgcagttagttttcagcacattagaggtagtcagcccacagtggccaagagtg

SEQ ID NO: 5773 - DNA, 174 bp, Zea mays
atggcgggctccagctggcggagcagcgcgtcgtcgtggccgccgatctcgtacaggacggcgatcaccgcggccttgttctcggcgctctcgtgcaccaggtgcagctccatgtcgtaccggcggccgtcgacggtgtgctcggtgggcgagtgccagtgcagctgcctcagg

SEQ ID NO: 5774 - DNA, 612 bp, Zea mays
atgtctttcaccggcacgcaggacaagtgcaaagcctgcgacaagacggtccacatcatcgacctcctcaccgccgacggcgtctcgtaccacaagacatgcttcaagtgcagccactgcaagggcgtcctctcgattagcagctactcttccatggacggcgtcctgtactgcaagacgcactttgaacagctcttcaaggagacagggaccttctcaaagaactttcaaggtggagcatcttcaaacaagaacgaccaggcaaaggctccaagcaagctatcatctgcattctctggaactcaagataaatgcgcggcctgccagaaaacagtgtatccattggagaagatgactctggaaggcgaatcctaccacaagagctgcttcaaatgctcgcacgggggctgcatcctcaccacgtcctcctacgccgcgctcaacggggtcctctactgcaagatccatttctcgcagctgttcaaggagaagggcagctacaaccacctcatcgagacggcgcagaccaagaagaacgaggccgcggaggccggaccggagccaccggcggacgcaggcgcggctgagccggaagcacccgcgcaatcggcg

SEQ ID NO: 5775 - DNA, 807 bp, Zea mays
atgggatccctcgctaataacatcatggtcgtgggcgccgtccttgcggcgctcgtcgccggcgggtcgtgcgggcccccgaaggtgccacccggccccaacatcaccaccaactacaacggcaagtggctcaccgctagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaggtgagatgcaaggaaaaacctgagtgctcgggcaatccagtcacggtgtacatcactgacatgaactacgagcctatcgctccctaccacttcgacttgagcggcaaggccttcggctccctggcaaagcccgggctcaacgacaagattcgccactgcggcatcatggacgtcgagttcagaagggtgcgatgcaagtaccccgccgggcagaagatcgtgttccacatcgagaagggctgcaaccccaactacctggccgtgctggtgaagtatgtggcggacgacggcgacatcgtgctgatggaaatccaggacaagttgtcggctgagtggaagcccatgaagctctcttggggcgccatctggaggatggacactgccaaggcgctcaagggccccttctccatccgcctcaccagcgagtccggcaagaaggtcatcgccaaagacgtcatcccggcgaactggagacccgatgccgtctacacttccaacgtccaattctac

SEQ ID NO: 5776 - DNA, 921 bp, Zea mays
atggacgccggcggaggcggcgtcttggccgccgtgctctgcatgctgctggtcttcgccatcttccttctcctcctctggcgccgccgctccgatgccgccaccgccgataaccaccgcgtcccgccccagcccctccaggaggatcaggtgctgcacggtcgcgcggcggcgcgacggatgcgtcggaggcctggggctgccggagcaggctcctctactgcgtcaactagccgcaatgctgtagaggacgacgcggagagtgacgatgaggaggtccccgaaggtcgcaacgtacccagatcctccaaaaaggagaagaaaaggcaagagcgagagatgcagcgtcaggccgaagaacctgcacgggattcatggaggagtaaacaagaccgatacgacgaaatgaggaggaagaaggatgaggagcgtgaggcacaagagaggcaattggaagaagaagctagggcacgaaaagcaaaggaggaggctgctgctgctttagagtttgagaaatggaaaggggccttctctgttgatgctgaaggtacaacagagagtgagacacaagacgatggtcagggtttgctccacaactttgtggaatacatcaagaagcagaagtgtgttcccctagaggacctagctgcagagttcaggatgcgaacccaggactgtatcaatcggattgttactctggaaagcatggataggttatctggggtgatggatgaccgtgggaagttcatctacatctccactgaagagatgaaggcagttgcagagtacattaggaagcaagggagagtgagcatatcacatctggccaacaactcaaaccagttcatcgatctggagccgaaggcccagtacgaggtggagagccagcaggatgacagtgcagaagcaggcacagaagca

SEQ ID NO: 5777 - DNA, 768 bp, Zea mays
atgagctgcagggagctgcaatcctgtgtgcgcaccggaagacggtgccgagagaagatggcccgctccaacttccgccttgtgatacatgttgctaggaaatatgaaggatgtggccttgacattcaggacctggttcaggatggatgctgtgggttgatgaaaacctttgagaagttcaacccgagcaagggatgcagattcccgacctacgcgtactggtggatacgccagtcgatcaaaaagtccatcttcaagaattcaagactaatccggttgccggagagtgtgtatgcacttttgaggaaggtgggcaaagcgaggatggaatgcataatggacggggagcagccgacgaacgaggtggtggcaaggcgtgctggcatcacgattgaaaagctggcgaaactgagagcgaaaaccaggaaagtacggtccatgcaggatcgagtctggtcagacgacggtgtgacataccaggagatcaccgaggaccccaacattgaaggtcctgaggtgagcgtggacaggctgatgatgcggcagcaggtgcgcagcttcctgacggggatcctgagcccccgggagaaggagatcatcgagcaccggttcggcatccacgacggccagcccaagaccctgcatgtcatcggcgacatgtacggcctgtccaaggagaggatccgccaggtgcagaacaaggccctggacaagctcagaaacagcatctcagcacagggcttccacgtctactttgatttgctaact

SEQ ID NO: 5778 - DNA, 447 bp, Zea mays
atggagcaaggtggcccaggaaggaaaagaagtcgtccagccaccaccataggaacagcagcagcaagagaaaatcaaagcacacaaggagtaggagtgatgatagtgaggaggatgaaggcagaagaggccgggacaggaagaagatgtccggcagatcgaagaagcatgaaagatctgatgaggctagcagcgatgacactgattcagatagacagaggcacaggaagagcaggaaggacaggaagaggaggagccaccgcaggagtgacgacacgttggatgagaaggatgtatctggaggtgaagaaaggaggcatcaacgtcaccagcggagccatcactggagggatgcatctgactgtgacaatggtgacagtgattctgcacatgacaagaagcaatccagcaggcggaggaggcattgccagtcagaaaacagtgggc

SEQ ID NO: 5779 - DNA, 240 bp, Zea mays
atggtgcccaccacgtgcgtcgtctgcgggtccacgccgtggtcgtacagccgcgccaggccgaagtcgcccagcctgccgttcatgtcgccgtccaggagcacattgctggccttgacgtcccggtggatcaccaccttctcccagtcctcgtgcaggtacagcaggccggcggcgacgcccctgacgatctggaacctctgcccccagtccaggacgggcctggcggtcctgtcgtcg

SEQ ID NO: 5780 - DNA, 270 bp, Zea mays
atggtggggcggcgtcgcgcggccctcccgacggctcgccgccggccgcgctgctgctgctgcagcagcccctcctccacgcctacgaggcccgcaaggacccggcggcgtgcggccgggaggcgcacgggcacggcttcggcccggaccccgacggcgccggcgccggcggaggcgcgagcttcgtgcggacctgcttcaatggcctcaacggcctctccggcgtcgggctgctgtccatcccgtacgcgctgtcggagggcgggtggc

SEQ ID NO: 5781 - DNA, 312 bp, Zea mays
atggtgcgcaaggcgaaggttgagttcgacgagcagccgccggataacttcgacccgaagaacccgtatgccgacccggtggcgatgctcgagtaccgggaacacctggtgcgagagaagtggatccatatcgagagcgccaagatcatccgggagcgcctccgctggtgctaccgcatcgagggcatcaaccaccaccagaagtgccgccacctcgtcgaccaatacctagaggctacccgcggcgtgggttggggcaaggatgcccgcccgcctgaactccacgagcccaagaagaccgtcaaggcggag

SEQ ID NO: 5782 - DNA, 558 bp, Zea mays
atggaggcggccttcgacgcctacttccgcgccgcagatctggaccgcgacggccggatcagcggccaggaggccgtcgccttcttcaagggctccggcctgccccagcccgtcctcgcgcagatttggacgtatgctgataaaaaccggtctggttttcttgggcgtgaagacttcttcaatgcactcaaacttgtcacagtagctcagagcggccgagaattgacacctgatattgttagatcagcattattcggcccagctgctgcgaaaatccctgctcctcggataaatgtttctacagctgctcctcaggcaagtagcgtagctaacctcccgaatgccactcaagcaccaggtcctgttcagcagactcctgtcgtaagagggacacaagggcttcctggtatatcgtcaaatccacaagtcaggccaccacaacctccaaatgcaaacactgcgccccctgctcagggtcagggagttgcctcaaggccacccgtaggaagtggtcccactgggataaacatactagctcaacacaccaagtctagcaac

SEQ ID NO: 5783 - DNA, 198 bp, Zea mays
atggaactggacctacgagttccagctcaaggaccagatcggcagcttcttctacttcccgtcgctcggccttcagcgagctgccggcgggttcggccccatcaccgtcaacaaccgcgccaccgtgcccgtccccttcgaccagcctcatggcgacatcaccctgttcatcggggactggtacaccaagggccacgt

SEQ ID NO: 5784 - DNA, 618 bp, Zea mays
atggccgccagcgtcaccgtggaaaacctcaaccccaaggtcttaaaatgtgagtatgcagtccgtggggagattgtcatccatgctcagcgcctgcagcaacaactacaaacacaaccagggtctcttccttttgatgagatcctctattgcaacattgggaatccccaatctcttggtcagcaacctgtgacattcttcagggaggttcttgctctttgtgatcatccgtgcctcttggaaaaagaggaaaccaaatcattgttcagtgctgatgcaatttctcgagcaaagcagattcttgcaactattcctggaagggcaacaggtgcatatagtcacagtcagggtatcaaaggactgcgtgatgcaattgctgctggaatcatgtcacgtgatggattccctgcaaatgcagatgacattttcattacagacggagcaagtcctggggtccacatgatgatgcaattactgattaggaatgagaaaaatggcattctgtgcccaattcctcagtaccctttgtactcagcctccatagctcttcatggtggagctcttgtcccctattaccttaatgaaaaactgggtgggggtttggagatctctgattct

SEQ ID NO: 5785 - DNA, 666 bp, Zea mays
atgtccgaggccgagatccgccagctctgcgtcgaggccaaacaggtgctgctttcgcagcccaacctcctccgcatccacgcgcccgtcaagatctgcggtgatatccatggacaatttgttgatctcttgaggctctttgatttgggtggttatcctccaacttcaacttatattttccttggagactatgtggatagaggcaaacaaagcttagaaaccatatgtctgcttctggcatacaagttgaagtaccctgataatatataccttttaaggggaaaccatgaagatgcaaaaattaacagagtttatggtttctatgatgaatgtaaaaggagattcaatgttcgactatggaagatattctgtgattgcttcaactgcttgcctatggcagcacttattgatgacaaaatattatgcatgcatggtggcctctcacctgaattgactagcttggatcaaataaaagatattgagaggcctaccgaaattccagactatggtcttctgtgcgatctcctttggtctgatcccagtcatgatacagaaggttggggggagagtgatagaggtgtttcttgcacttttggcgcagataagcttgttgaatttttttggagaagaatgatcttgaccttgtgtgcagagctcatcaggtgg

SEQ ID NO: 5786 - DNA, 699 bp, Zea mays
atgccgcgcccgcgccacggaaggcggaggccgagactggcggggacgaggacggttgtgctggtaaggcggcgccggcgaagaagcgggagcggagcagcgaggggaagcacccgacgtaccgcggcgtgcggatgcgggcgtggggcaagtgggtgtcagagatccgcgagccgcgcaagaagtcgcgcatatggctcggcacgttcccgaccgccgagatggccgcgcgcgcccacgacgccgccgcgctcgccatcaagggccgcgccacgcaactcaactttccggtcctcgccggcgtgctcccgcgcgccgcgtccgcggcgcccaaggacgtccaggccgccgccatgctggccgccgcgttcacgtcgccgtcgtcagcaccatcggagctcgacgccggcgcgccggcgccacgcgaagtgcccgccacaaagaacggctccccgtccgaggacgaggcaggcgctgaggcgccggtaccaccggcggcggcctctcagccagggacgccgtcgagcggcgtggacgaagagcggcagctgttcgacttgccggacctgctcctcgacgtccgggacgggttcgggcgcttcccgccgatgtgggccccgttccatgacgtgttggaggtcaatgcggaggaggagccgctgctttgggaatagcagtcttgcaattacaaagagggtc

SEQ ID NO: 5787 - DNA, 744 bp, Zea mays
atgaacgaagaaataaatctagctgatgcccctccccatcatcccgttgtactgtacccacgaaatcgggcgctgcagcttcatctgcgcgtaaaacctggcgatgaactcgtccgccttgacgtccaccccggcgtcctcgccgctgtccgctgccaccgaccgtccggccgagctcgcgcggaaggcctccgccaccacgcgctcaaaaagaatctcgccatcgccgcaaaagctcggctcttcgtcgtcctcctcctcatcatcgtcgaggtcgccgtagcagcacccggggccctcgcccgtctcccacgcggcggcggcggcgctgaagaagtagcggtcgtcgccgtagaggcccggcgtgtccggcacgtccggcgcgatgcaggggatgaggcggagcacgcgcgcggacggggtgcggaaccggaacgccggcgtctcgtcgatggagtactcgcgctcgccgcagcggagccggtcgccgcgcgcgccgcccagaccggcgaggccgtggccgtggcggcggagcgtgcggagcaggcgcaggcgcaggctgtgcgccgcgccgcccttccgcgcccacagcaccgccagccgcagcagccgccacgcccgcgtcccgaacgacggcctcttcagtcccgccgccattgcgctgcgtgtcggatcagatggcggcgcttcgttcgtcgaatgcgaaatgccgctggatcgtctctccgcactgctttgctcggg

SEQ ID NO: 5788 - DNA, 330 bp, Zea mays
atggggtcgtcgcagtcggggcacaggatggcgcggtcctccacgcagaacacgaggcccctccgctccttacacacgtcgcagagcggcttggcgtcggcgtcggattcgtcgccagagggctgggcgagggggatgcggcggtgcttgtgggcgagcttgttggcgcggtggacgcggcggtcgcaggcggagcagagcgcggcctcgtcggcgcagcagatcacggcggccggcgcggcggcgcagacgtcgcagagcatctgcatggcgcgagcctatcgcggatcggcagagctcagccgctcagggagagaatctggtaggcac

SEQ ID NO: 5789 - DNA, 282 bp, Zea mays
atggaggcggctacggcggtggcggtggcggctacggaggtggtcgtggaggctacggcggcggcggtgggggatacggtggtggaaaccgcggcggcggctacggcaacaacgacgggaactggaggaactgagcggtggggtccgctgaggcctagttatcttgttcgcttctgctaccgtgttcaccctagtctagagggggtttatcttcgtctgtggtcgtctcgtgtccgtttgtttcgtttcgtgttcattgttgttgttgcccatctgtgtttt

SEQ ID NO: 5790 - DNA, 834 bp, Zea mays
atgtcttccatggagctgctccacgccgtcgtcccggagaagcagagcgaggaggaggtcgcgcccgcagcgacgaccacgagcagcagcgccaccgccacgggcggggacgagggcgcccacgtgccccaggggtgggccaagaggaagcgctcgcgccgccagcgatcggaggaggagaacctcgcgctctgcctcctcatgctctcccgcggtggccaccaccgcgtccaggcgccgccaacgccggtcccgtccgcggcgccggccgccgcggagttcaggtgctccgtctgcggcaagtccttcagctcctaccaggcgctggggggccacaagaccagccaccgggtcaagctgccgacgcctcctcctcctcctactgccgccgctgtaactgtctcggcagcagtgcccgtcccggaggcccccgccccgatcaccgtcgtcgtcccgccgctgccgccagtcgaggtcggccgcgagccggccacgtcatccaccgccgcgtcctccgacggggcggcctcgagcagagtccacaggtgctccgtctgccacaaggagttcccgaccggccaggcgctcggcgggcacaagaggaagcactacgacgggggcgtcggcagcgccgccgcgtccaccgacgtcccggcggcgcccgccgagacgtccgccgaggtcgggagctccgccgcgcgtgcgttcgacctcaacctcccggccgtgccggagttcgtgttccggtgcggcaagcccggcaagatgtgggaggaggacgaggaggtgcagagccccctcgccttcaagaagccccgcctcctcatgaccgcg

SEQ ID NO: 5791 - DNA, 255 bp, Zea mays
atgtcgtcccggccgcagacgtcgaggtgccgtaccaggagccgcccgaggcgtacctcgccaagttcaggcggagctgggccatccactttgccttcctcatcaccacattcgcattctgcgtcgccgcctccgtcgcaatcctctgcttctagtacccttctatggctgctgcttctagtttttggatcgatctgtctaggagatcctggatccatctctctgcatagcataatgcatcagttgaatagagtc

SEQ ID NO: 5792 - DNA, 198 bp, Zea mays
atgacagacttgggtccggtgcagcccatggtcgtcccgagccctccgttgagcttgagcacaacgagcttgtccagcagcttcttcgtctcctcgagatcttcaggaggcgacgtgagggtatcgtacggcaccactacctcatcggtcggggtctggatcttgctccactcgatctgctccgcctccccactgagg

SEQ ID NO: 5793 - DNA, 750 bp, Zea mays
atgaggttcagctgcagcacaggggatgccatggggatgaacatggtctccaaaggtgtacagaacgtgctggactacctccaggctgacttccctgatatggatgtcatcagcatatcaggtaacttctgttctgacaagaagtcagctgctgtgaactggatcgatggccgtgggaagtcggtggtttgcgaggcggtaatcaaggaagaagttgtgaaaaaggttctcaagacaaacgtacaggctctcgtagaattgaacgtgatcaagaaccttgccggttcagctgttgctggagctcttgggggtttcaatgcccatgcaagtaacattgtggcagccatcttcattgctactggtcaggaccctgcacagaacgtggagagttcccagtgcatcaccatgttggaagctataaatgatggcaaagatctccacatctctgttactatgccatctattgaggttggcacagttggtggaggcacgcagctggcctcacaatctgcctgcttggacctgcttggcgtcaaaggtgccaacagggaatctccggggtccaacgcgaggctcttggcccacgtggttgcggggtgcggtcctagctggggagctgtcccttatctctgcgcaggccgctggccatctggtcaagagccacatgaaatacaacagatccagcaaggatatgtccaagacccttgcagaggaaacagacaaacccaagaaatgctgaataatatcaag

SEQ ID NO: 5794 - DNA, 411 bp, Zea mays
atgcatcgatcagcccctgcactgggtgatggcgctgcagccgcgggagtaggggttggcctcggcgccgggctggcagttgtagtaggacgcgccgcgctgcgagcagggcacgttgtcccggcgcagcgcgtcgtagccgatgtagccggagccgccctgcagcagccggcgcttggctgccgcccgtggccatggcgggggcttcgggcttgcccctcggggcggatgtccagcgaactccgaccgctcgccccaccgtcagtccctacttcggcccggcgcgcctggcgttgcgggccggctggagtaacctgccctgctgcttacgttcctgtgttgcgtgtgaccctccggttctgcgattcttcttcgtcctttatgtttcctctctcccgtcgccaccctatt

SEQ ID NO: 5795 - DNA, 759 bp, Zea mays
atgaccggcagtggaagcacgggcgccaatggcaagagccagagctccagggccaaggcaatgctgctcgccttgggcaagagctttcctgaccaagttctgcctcaggagaaggttgtggagagctacctccaagaaagcagctgcgacgatcccgccaccagggccaagcttcagcgcctttgcacgactacaacagtgaagacaaggtacactgttatgtccaaggagctattggataagcacccagagctgaagatggagggtactccgacactgacaccccgccttgacatctgcaatgccgcggtgatcgaccttggtgctgccgcagctcgcgctgcccttgacgaatggggtcgccctgcagctgatattacccacctcatctacatctcatcaagtgaccttcgtctcccagggggcgaccttcacctggctgctcgccttggccttagcccaaacaccgtgcgcacttcccttctcttccttggctgctccggtggtgctgctgccctccgcactgccaaggacattgctgagaacaatccagggagccgtgtcctagtaacagctgctgagaccactgggctaggcttccggccaccaagttatgaccgttcttatgaccttggtggggctgcgctgtttggtgatggtgcatcaaccgtgattataggaggcaggtcgcatgacaccaagagaaaatccttttcttggagcttgagttctccccggcggagttcctacctgggactg

SEQ ID NO: 5796 - DNA, 606 bp, Zea mays
atggggcttgactactacaagatcctgggcgtcgacaagggcgccaccgacgacgacctcaagaaggcctaccgcaagctcgccatgaagtggcaccccgacaagaaccccaataacaagaaggaggccgagaacaagttcaagcagatctcggaggcatacgatgtcctcagcgacccgcagaagcgcgcggtgtacgaccagtacggcgaggaggggctcaaggggcaggtgccgccgccgggcgccggcggggcgggctcaaccttcttctccaccggcggcgacgggccgacggtgttccggtttaacccgcgcaacgcggatgacatcttcgccgagttcttcggcggctccagccccttcggcggcatgggcgggagtgggatgcccggcatgcgggccggcgggtcgaggttctcctcgtccattttcggggacgatatgttcggctctgcgttcggcggcggcggcccggacgggcacggcatgcacaccggcggacgtgccgtgaaggcgccggccatcgagcggaagctgccgtgcagcctggaggagctgtacaaggggcaccaccaagaagatgaagatttccagggaaattgc

SEQ ID NO: 5797 - DNA, 576 bp, Zea mays
atggatatgcaaaaacggatagtattggatgctaagattgattatccagcagcatgtaatgcaatggaaacactacttgttcataaagatcttaacaagagtgagggacttgatgatctattagtggaacttgaaaaggaaggagtagttatttatggtggacctgttgcacatgacaagttgaaagtaccaaaggtagactcatttcgtcatgagtatagctcaatggcatgcacagtcgaatttgttgatgatgtgcagtcagctatcgatcacataaatcgttatggaagtgcacacacagactgcatcatcacaactgatagaagtgctgcagaggcctttctgcagcaagttgatagtgccgctgtgtttcataatgcaagcacaaggttttgtgatgggacgcgttttgggctaggtgctgaggttggcataagtacagagcgcatacatgcccgcggacctgttggagttgatggacttctaactactcgctgcattttgcgcggtagtggacaagtggtgaatggtgacaagggagtggtttacacccacaaggatcttcctttgcaa

SEQ ID NO: 5798 - DNA, 441 bp, Zea mays
atggacccgcaggtggaggtgcgccaggtggagcccaacgagttcttcctgcagatgctgtgcgagcgccggcccgggcgcttcgtccagatcatggactccatcgccgacctgggactggaggtcaccaacgtcaacgtcacctcccacgagagcctcgtcctcaacgtcttccgcgccgccaggcgggacaatgaggtggcagtgcaggcggacagactgagggactcgctgctggaggtgatgcgggagccgtacggcgtatggtcgtcgtcggcgccgcccgtggggatgagcggcagcggcatcgccgacgtgaagcatgacagcgtggacatgaagctcgatggcatcatcgacgggcaggcggcaccgagcgtcgcagtgggggtttcagaggatcactacggcggctacaaccatctcctccaatacctcgct

SEQ ID NO: 5799 - DNA, 402 bp, Zea mays
atggagataacatcaaagcctattgaattggatgaggtagacagagaaatcataaggcttgaaatggaaaagctctcattgaagaatgatacagataaggcctccaaagaacggctgagcaagcttgaagctgaactagaatctctcaagcagaagcagaaaagtctttcagaacattgggaatatgagaagtctttgatgactcgtataagatcaattaaagaagagactgacagagtgaacctggagattgaagctgctgagagagaatatgatttgaatcgtgctgctgaactgaagtatggaacacttttatcacttcagaaacagctggaagaggctgagaataaacttgttgaattccagccaatcagggaagtcaatgcttcgagaagaggtgac

SEQ ID NO: 5800 - DNA, 729 bp, Zea mays
atggcgtccgtggccgcggcggaggtcgcggcggcggcgctccggtcggtgctgtcgcgcgcgcagcaggcggcggcgcgggcggggcgcgcgccggggtccgtgcgcgtggtggcggtgagcaagaccaagccggtgcctgtcatccggggcgtctacgacgcgggccaccgctgcttcggcgagaactacgtccaggagctcatcgacaaggcgcctcagcttcctgaggatattgagtggcacttcattgggaatctgcaaagcaacaaagccagagccctacttgctggcgtgccaaaccttgatatggttgagagtgtcgatgatgagaagattgctaaccgtcttgatcgagtggtagctgacttgggaagaaaacctcttaaggttttggtccaagtcaacactagtggagaagaatcgaaatttggagtagatccctcaggatgcatggaactagcaaagcatgtcaaactgaactgcccgaaccttgtgttctctggtctgatgacaattgggatgcttgattactcctcaacccctgagaatttcaaggcgctggctaactgccgggaagaggtgtgcaaggagcttggaatacccgaagagcagtgcgaattgtctatgggcatgtcggctgattttgaacaagcgattgaaatgggaagcacaaatgtaagagttgggtcaaccatatttggtgcaagagaatacccaaagaagaac

SEQ ID NO: 5801 - DNA, 339 bp, Zea mays
atgaagcccatggcgagctcccgcgccgtgatccacgacatggacgacggcttcgagatcaagttcgcgcccgggaagcctgcggcgtggaagcacgacggcaaggccgacagcaaggggagtcgtcagggccacggccagggccagggccagcgtcagcatcacggccagggccagggtcagggtcagcatcagccccagctcgttggcattcccaaaggctacgccgtgccggtgcccgtgcccaaggactacgcgggcttcagataccctgcggaagccgtggtcaggcaggggcagatcaggggcggggcattcgttccagcgaagcctggcaca

SEQ ID NO: 5802 - DNA, 405 bp, Zea mays
atgcattgtaattacacctcctgggacctctcctactggaacacgggactctgcaagtgtccgattattctccaatatccttccagcattgataagcttcaagtcattaacagtttttggagttatatccttatcttgcggccaccgagcgaggatgaactccttgagcgaggagaccgtggtggagggatcgtacttggtgggcccgatgtccgtgccgtcgaagagccggaacctgacctcgatcggctccttcccgccggccatatcctccccgccagatcgccggcggcggcccaccacacctccccttcccaagatccaagccccggatcaaaggcccataggagcaaggaagcggccaaaaaaaaggaaatccacagaaacacgcgcaaggtgggaatt

SEQ ID NO: 5803 - DNA, 171 bp, Zea mays
atgcgacgggcaccggcgagccccacgtgtcgccggagccgccgcttgtactccttgaagtactccacctccttccacagcgggatcactgacaggacgccggcggtcttgttgtcgaggccggtgcctgcggaggcgaagcagacgccgcgggcgaagtcctggatgccg

SEQ ID NO: 5804 - DNA, 888 bp, Zea mays
atgtatgacgagttggctagcaagagcaatgttgaatatattgccggaggagccacccagaactctatcagggttgcccaatggatgcttcaaactcctggtgcaacaagttacatgggatgcattggaaaggacaagtttggtgaggaaatgaagaaaaacgctcaagctgcaggagttactgctcattactacgaggatgagactgctcctactggcacatgtgctgtatgtgttgttggtggtgaaaggtcattgattgcaaatctgtcagcggcaaactgttacaaatctgagcatctaaagagaccagagaactgggcactagttgaaaaggcaaaatacatctacattgctggatttttccttacagtgtcgcctgattctatccagctagtcgctgagcatgctgcagcaaataacaaggtgttcctgatgaacctctctgctcccttcatttgtgagttcttccgtgatgcccaagagaaggtcctcccgtatgctgactacatcttcggcaacgaaactgaggcaaagatctttgccaaagtcagaggatgggagactgagaatattgaggagattgctttgaagatctctcaacttcctttggcttcaggcaagcaaaagaggattgctgtgattactcaaggtgctgatccagtggttgttgctgaggatgggaaggtgaaaacgttccctgtgatcctattgcccaaggagaagcttgttgacaccaacggcgcaggtgatgctttcgttggaggcttcctctcacagttggttctaggcaagggcattgaagactgcgtgagggcaggttgctatgccgcaaacgttatcatccagcgcccgggctgtacttacccggagaagcctgacttcaac

SEQ ID NO: 5805 - DNA, 144 bp, Zea mays
atgtcgaagagccgggcggtgaggctgagcaggcggctgaagcagctcaacggctactcgtccctgtgcaacgtgctctgtctcatgtccctcacctggcacctcgtgcacctcgcgcgccgcctacacgcgggcaccgcctgc

SEQ ID NO: 5806 - DNA, 195 bp, Zea mays
atggtcatggctcttgatcatggctacgtagtgcccctggttggggccgctccccaggtggaccaccacggcaaagagggagtactcacagtcggcatcagcggagttgctgctgagcttaagctccaaggggtacaccactcggtacgacagcttcttgtgccggttaagctgctcgatgaacttgaagcgctt

SEQ ID NO: 5807 - DNA, 243 bp, Zea mays
atgcacttatctgtgaaaaaagatctgctaggcaggtcaacaaattttcttcagcatcttcgagatttctgtttcttctatagtattccagcaactgttcccggaatggagcacaataatacaatgcctggaggacgctgttgcagtagcaggtgttgccgaagttctcgagcccgaagtagcgctcgccctcggggaactggtcgccgaaggccctttcgagcttggagagtccggaaccaa

SEQ ID NO: 5808 - DNA, 204 bp, Zea mays
atgttcttgtcaaggaggacgttgctggccttgagatcgcggtgcaccaccctgagccgggagtcctcgtggaggtactgcaggccccgagcgatgccgttgatgatcctgtacctctgcccccagtccagctccagcggcggctgttcacgtccatcagcaccgaagagtgccaggtcgaggctccggttggggacgaactcg

SEQ ID NO: 5809 - DNA, 354 bp, Zea mays
atgctggacaagctgtgggacgacgtggtggccgggcctcgcccggagacgggcctcgagaagctccgcaaggccaccaccgcccgcccgctcgtcatcaacaaagacgcggacggcggcagctacaagcgggcgcagtcgatgccgtcgaccccgacgacgccggtgacgccgtcgtcgtcgtcgtcgtcgacgacgccgcgcggcgccggcaacgtgtggcgcagcgtcttccacccggggagcaacctggccaccaagggcatgggcgccaacctcttcgaccggccgcagcccaactcccccaccgtctacgactggctctacagcgacgagaccaggagcaaccaccgc

SEQ ID NO: 5810 - DNA, 495 bp, Zea mays
atgagctctcaccgtgtgaagtggaatgaggacaatttgtatgaaattgagtcaaacaaaccggtgaggcagaagataacagagccaaagacaccatatcacccaatgatagatgatgatggatcattgtcgccaacacgtcctttcgacaaatgtcttgatgagactgtccaggctgaagctatcttaacagccttaaatggtgtggcttcttcaagcattagcatttcaaaggatgatggttggggatcgtcagatgatgatacagatgccatagatcaagatgctgaccctgaagctgacacgacaaggttgagtttcaaggagcatcgccgtgcccactacgatgagtaccgcaaggttaaggagctgatgaggactggatcccttactgctgaggaggccgatgaggataacagagctgccaccagctccgaagacaaaggtgtggggaaaggagggccgaatgataacatgaagccctcgcctcaaaca

SEQ ID NO: 5811 - DNA, 516 bp, Zea mays
atggcggaatccatcgtctccggcgccgccgccccgccgccgggcgcgccctcgttctcctacctggccgtgttctccaactgcccgctcgtcgccgcggtgctcgccttcgccatcgcgcagtccatcaaggtcctcaccacctggtataaggagaaccggtgggacgcgaagcagctggtgggctccggcgggatgccgtcctcgcactcggccaccgtcaccgcgctcgccgtctccgtcgggctgcaggaggggttcgccagctcgctgttcgccaccaccgccgtcttagcctccgtggtgatgtatgatgcctttggtgttaggctacatgcagggaagcaagcagaggtcttgaaccagattgtgtacgagcttccatcagaacatccactagctgaaacaagaccgctgcgagagctgctagggcacacacctccacaggtatttgctggcggagtgcttggatttgcagtagccacatttacagcgatgattgctgggcttggtagt

SEQ ID NO: 5812 - DNA, 396 bp, Zea mays
atgacgttcaagcggaggaacggcggacgcaacaagcacgggcgcggccacgtcaagtacatacgctgctccaactgcgccaagtgctgtccaaaggataaggctatcaagcggttcttggtgaggaacattgttgagcaggctgctgtgagggacgtgcaggaggcttgtgtgcatgatggatatgttcttcccaaattgtacgcaaaggttcatcactgtgtctcatgcgcaatccatgcgcacattgtccgtgtccgctctcgtgagaacaggaggaaccgtgagcccccgcagcgtttcaggcgccgggatgatggcccaaggccaggtcagggcccaccgcgcccaggtgctgctgccacagcagctccccctgctgccgctcctcgtacc

SEQ ID NO: 5813 - DNA, 453 bp, Zea mays
  misc_feature (436)..(436): n = any nucleotide
atggtgtttggctcactgcggctccaccgcctggtcgtcggcggcaacggtaggcgctgcctctcggagaccgcctcggtgcactcgtacgccgcgattccaaactcctccacgagctgctccgccgtcagcgccatgagcgcgacgacgccctccgcggcccgggcctcggcctcgaccacctgctcggacacgagcccctccccgcgcgtgcagaaggcccgcttcaggctccggaagtcctcttcgaccatcgcgtggtcctccaccgtgaagctcctgtcgctgccgccggcgagcaggacgatgaggaacccctggaacgaggccttcatcacctcccggacggccaccggctgcgcgcggtccacgaggatggagacgagcagcgacaggttctgcttcagcgcgcggagcgcggggcggatgcgggcgncggcgacgcccccgacg

SEQ ID NO: 5814 - DNA, 759 bp, Zea mays
atgagtgagttgtcacttgctgatcgggcgaccatcgcaaatatgtctccggaatatggtgcaactatgggattcttcccagttgatggaaagacgctggactatttgaagcttactggccgaagtgatgatacagtggccatggttgagtcctacctgcgtgcgaataagatgttcgttgatcacagccaggttgacgctgaaagggtatactcttcctatctagaacttaacttggaagaggtagaaccatgtctatcaggaccaaaacggcctcatgatcgagtgacattgaagaatatgaagtctgattggctttcttgcttggacagcgatgtaggattcaagggttttgctgtccccaaagaatcacagggcaaagttgcagaattttcgttccatgggactcctgcaaagataaagcatggtgatgttgtaattgcagcaattaccagttgcacaaacacatcaaatcctaatgtaatgctgggagctgctttggttgccaagaaggcttgtgagttgggcctggaggtaaagccatggattaagacgagccttgcacctggttccggtgttgtgaagaatacttggataagagtgggttgcagaaatatctcgaccagcttggctttcatattgttggctatggttgcacaacctgcattggaaattctggagagcttgatgaatctgtgtctgctgcaattactgagaatgatattgttgctgctgctgtgttgtctggaaacagaaatt

SEQ ID NO: 5815 - DNA, 438 bp, Zea mays
atggttggattgctcgatcgatcgacctcccttcacaccaccgccgaccgaccgattcaggcgcggaagcagccggcgatgtggaagtggttgctgttgtggtgtcctcctccaccgccgccgccgccgccgccggagacgcggtggtggtggatgatgccctggacgcggcggaagtggtcgacgccgcaggggatggtgatggcgcccttctgctcgaagccgtactcctcctccgccgccttgagcagcgccacgaagagcgggtgcgtcaggtaccccacggggaccacgaaccgctcctcctcctcctcctcctccttatggccgccgcccgcgggccccaccacgcgcaccgccatacaccccttgggcggcatcgacgacccggacccgccgcccagcgacggcgcggacgagtgctgcttcttcagccgg

SEQ ID NO: 5816 - DNA, 870 bp, Zea mays
  misc_feature (718)..(718): n = any nucleotide
  misc_feature (794)..(794): n = any nucleotide
atgccgtggggcggctgcccgtgctcgctcgagccgccttcgtcggttatgtcgctggggacggcttcgtcgtcttcgcctgggtcgtcatccccggcgcagaggttgagatcaagcctgcccagcccggcgtcgtgccgtgcccgcttgccctcgccctcgccctcgccctgcggtgactccgtcttcctcttgagagcgccgtcggacgacgcctcgtcctccgaccacaggcgcaggttgattgggtcgctggcgccgccaggcaacttcgatgctaccaggatcacgatgcagccggagagacgcagcacttgtccggattcggcatccttcagggaaccgctcttcgacgcggcgaccaggcagtcggccacgtcgcacggcgcgttctcgacaccgtccacgactaccaccaccaccatctcgccgcccatctcagacgccctggatacaacatctgagcacagctcctccgcgcagctgtacttgctcgggtcggtgcggaccacgcgaccagccgagccgcagcacgtctctgcgatcaccgtgacagcgcgcccgcgtggcgctgtggtctctgcccttcacgtacagccacgagcccagcgtgccgtcgcgctctcggcggctactagcaaccaccgccttggcaatctccgcgacgacggcccgggctgccacgggatgttcctgcgcagcctctgccccagctggngcaccacccccgcggaaccgtcaccgcctcccgagcgcggctctgagatgtccccgagtccgagagcaggtgcctnccgagagcaagcgtgtttcccacgccctgacatgcttccctcgtcgtggactcaggcaccaacgagggggccccct

SEQ ID NO: 5817 - DNA, 780 bp, Zea mays
  misc_feature (686)..(686): n = any nucleotide
atgtgtttcagtgcaaggggtgctgtgagcagcacgcagtgtgtgctcacatcagatgctggcccagacactcttgtcgtccgaacatcctttcggaggaattatgctgatcctaatgaagtcgctgccgtcattttgggtggtggtaccgggactcagcttttccctctcacaagcacaagggccacccctgctgttcctattggaggatgttacaggcttattgatatccccatgagcaactgtttcaacagtggcataaacaagatatttgttatgactcagttcaactcagcttctcttaaccgtcacattcatcgtacctatcttggtggggggatcaacttcactgatggatctgttgaggtgctggctgcaacacaaatgcctggggaggctgctggttggttccagggcacagcagacgccgttagaaaatttatctgggtacttgaggattattacaagcataaagctatagaacacattttgattttgtcaggagatcaactctatcgtatggattacatggagcttgtgcagaaacatgtcgatgacaatgcagacataactttatcatgcgctcctgttggagagagtcgagcatctgactatggattagttaagttcgatagttcaggccgtgtaattcagttctctgagaaaacagagggtgctgccttggnaagaaatgaaagtgggataccagcttcctcaatttcggcattggatccccagcctgaatatccctatatcgcttcaatgggagtttacgttttt

SEQ ID NO: 5818 - DNA, 519 bp, Zea mays
atgatggcgatggcggcggtgtgccaggtgaggagcccggtgccgagggcggttgaggcggagcatgtggccgtggggtggccgccgtggctcgtcgccgtcgccccggaggccgtgcgcggatgggtgccccgccgcgccgagtcgttcgagaagctcgacaagattggtcagggtacatacagtaatgtttacagagctcgtgacctcgaaaaggagaagattgttgctttgaagaaagtgcggtttgataatttggaacctgagagcgtgaaatttatggcaagggaaatcctcattttgcgccgacttgatcatccaaatgttatcaaactagagggtctagtaacatcaagaatgtcctgcagcttatatcttgtttttgagtacatggagcatgatctagccggactagcttctttccctggagtaaaatttactgagtctcaggtaaagtgttacatgcaacagctcctccgtggtcttgagcattgccacagccgtcacattctgcaccgg

SEQ ID NO: 5819 - DNA, 384 bp, Zea mays
atggtgactcctggctccgactctaagaaggtgacacctgaggtgatcgcccagtacaccgtccgtaccctccagaggaccgtccctgctgctgtgcctgctgttgtcttcctctccggtggacagagcgaggaggaggccaccctgaatctcaatgccatgaacaagctcagcaccaagaagccatgggccctgtccttctccttcggccgtgccctccaggcgagcaccctcaaggcctgggctggcaaggtggagaacgtggagaaggctagagcggccttcctcgccaggtgcaaggccaactccgaggctaccctcggcacctacaagggtgatgctgccgccgacaccgagagccttcacgtcaaggactacaagtac

SEQ ID NO: 5820 - DNA, 315 bp, Zea mays
atgacccagaagccggcgtcggcgatagtgtcaaagctggagcagatcgttgagtcagagcgcttcatggtgaaaaaacaggacgggctggtgaagctgcaggggtccaagcaagggaggaaggggcagctcgcgatcgacgccgagatcttcgaggtgacaccggcctttcacgtcgtcgaggtgaagaagtcggcaggcgacacgctggagtatgagatgttctgcagcaagggcctaagaccttcactcagcgacatctgctggagcagccgatctgaggagaacatggctccttcagtggttcagccatca

SEQ ID NO: 5821 - DNA, 153 bp, Zea mays
atgacgaggcgccggtcgtcgaggacgtcaaggaagacgaggacgaggatgacgacgacgaggacgacgacgacgctgacgatgatgacgccgatggagacgccgccgcggcggcgccggccgacgaggaggaggaggtcgacgaggccggga

SEQ ID NO: 5822 - DNA, 756 bp, Zea mays
atgaacctgtggagcggcggcgggtggtcactcacgtcgtggcgggacgccgacgacccctcgacgggggaattccggtacgcgatggtcaggcgaggagggttgctgcccgagatcgtgatgctggactcgagcgacgccatcaagtaccgcacgggagtgtggaacgggcggtggttcagcggcatcccggagatgaactcgtactcgaacatgttcgtcttccatgtgacggtgagccagagcgaggtcagcttcagctacgccgccaatgccggcgcgccgccatccctttcccgcgtcctcctcaactacacggctgaggccgtgcgcgtcgtgtgggtgccggacaagcgagggtgggcaaacttcttcacgggaccccgagaagactgcgaccactacaacaggtgcgggcactctggcgtgtgcaatcagactgcagcgtcgacggcgtggccgtgcagctgtgtccagggcttcgtccccgtctcgtcgtcggactgggacgggagagaccatctggcgggtgccggcggaacgtgtcgctggactgcggcgacaatggcaccacgggacggctttttgtcgtttgcgggagtgaagctgccagacaccctcaactcgtcgctggacacgagcatcacgttggacgagtgcagggcgaggtggcctgccacctgctcctgcgtggggtatgccgcgggcagatgttcagggcgaggccataagttggaactggatcatcatgtggcc

SEQ ID NO: 5823 - DNA, 513 bp, Zea mays
atgctcggagaggtcgtggtagaaagcgtactccgcttcgtagtcgtggaggtccagctccgccttttggttgctgtggtaatggtgcttggcgtcggaagacttgccgaagccgaacacgctgactctgtcacacactcccaccgcgaccatgatggcctgcatcccggacgagtaatggaacatggcggcgtcgtgcgcgcggtcccactcctcgggcgcgcggccggtctcggcgacgaatcggcggagggagtagtacttgacgatgcgcgcgcagaggacgtcgaggcgggcgtcggtgacggagatgggggagccgtggcgggtggacgaggtggcgttgcaggcggcgacgtcgaggaaatgggcggcctggcagatgtagagcaggatggggacgccgtggccgtaggggtggcagaagcagccgggccggcgcgcgcagaggtggaggatgttgctgttgatgaaggagaagttggtcttgctgccgacgtgcgcggcgtagcc

SEQ ID NO: 5824 - DNA, 1098 bp, Zea mays
atgctgcgctgccacacgccaccgcaatgcgcccgcgcgccgctccgccaccacggaaggtgggagtcgcctccggcggcggcgcccgcggtggtagtgcggtgcgcgcggggtgcgccgcaggtgtccgggatcgaggcggcttcgccgggccacgcggctgtcacggcggcgttagctaaggcggaagggggtgacgcgcggcccagcctggccgagcggctgcggttggggaacctcctggaggacgggctatcgtacaaggagagtttcatcgtgcgctgctacgaggtggggatcaacaagacggccaccgttgagaccatcgccaatctcctccaggaggtaggatgtaaccatgcacaaagtgttgggttctccactgatggcttcgccacgaccactacaatgagaaaacttggacttatttgggtgacgaacagaatgcacattgagatctacaagtacccagcttggggtgatgttgttgagatcgaaacatggtgccaagaagatggaagaattggtacccgtcgtgattggatcctcaaggacctagctaatggtgaagttattggcagagctaccagcaagtgggtcatgatgaaccaaaatacacggagacttcagcgggtcagtgatgacgtgagggatgaggtgtttatgcactgtccaaaggcgccaagattagcattcccagaggaaaataatggcagtttgaagaagattccgaatctttcagaccctgcagaatattcaagacttggactagtgccaagaagagctgacctggacatgaaccaacatgtcaataatgttacttacataggttgggtcctcgaaagtgtacctcaagatataattgatacacacgagttacaaacaatcactttggattacagaagggagtgtcaacaggatgatatagttgattctcttacttgcatagaggaaggagaggagaaaagcatgaacggctctgcttctgcagcagcgcctcacaaagaagagcggcagcagttcctgcattgcttgagatttgcagccaacggacacgagatcaaccgtggccgtaccgtgtggaggaagctagctaga

SEQ ID NO: 5825 - DNA, 282 bp, Zea mays
atgcatgcagcaacaaacaagagcagaaaagtgcagacgttcggttcgacaacgacaacccgtgtggtcagttggcgttccttgtgcaccggacgacggtggcacggagcggccggcgcatcacgacggacagctcctgcttctcggcgaactccaccggctcaccggggacctggagccactcgaactcggcgacgagactggccacgaagaactcgaggtgcagcagagcgagcgccatcccggggcagatccgccgcccggcgccgaacggtatcatct

SEQ ID NO: 5826 - DNA, 384 bp, Zea mays
atgtcgttgtctcaatctgaatcggagactgagggctcagaggactacgaggactcgtcatccactcaaagtgacggcacaacggcaacagcggaggagaatggaagggccactcccaagcctattaggcgctcggcatccatggattctccattgtttctcgtagctgttcctgaagctcaggatgatgtcatgcagtataattgcaagttgccaaatgctcgagagatgaaggtcttcagggtcaaggagaaggaggcagcaggcacttcttcgacctcttgtcagtcaggccggttcaagattggcaggtccatgtcaagcagtgggcaggggtttttcttctcacggaatggccgctccagtggtgctgtgctgccactg

SEQ ID NO: 5827 - DNA, 720 bp, Zea mays
atggcgtcggaggtggaggacgacgcggcggtgccgggcgcgccgctggtcgccaatggtgcagccgacgtccgccggaggagggatcaggctaaggcgattttgtccaagcaggccgtcaagatcgccaccaaggccgagcagcacgagcgcttcatctttaaggtcacacacttgctgggtgttcttggatttgggggattttgctatctcttgggtgccagaccacaggatgtgccatatgtgtactgcctgttctatgtcatattcgttccgctccgctggatttactaccgctacaagaaatggcattactatctcctggacttctgctactatgccaacacctttctccttgtaatgattctcttctatccgaaagatgaaaaacttttcatggtttgcttctcgtttgcagagggtccacttgcttgggcattaattgtgtggcgttgcagcttagtttttggttcatttgacaaacttgttagtgtcctgatacatctcttacctgggattgttctattcactatccggtggtgggatccacaaacatttgctgccatgcacccggaaggaagagatgccagagtcacatggccatatgtggaggacaaatcatatatgtggacatggcttttttttgttccactagctgcttacaccctgtggcaacttatgtatttcctcatagtaatgtcctgcgccggcagagggttt

SEQ ID NO: 5828 - DNA, 549 bp, Zea mays
atggagcaaaccgaggcggcggtgagcggcgcgcttggagcgggagtggaaggtggcgacaagacggcgaggaaggcgctgaaggtggtggcggccgtggacgcgagcgaggagagcctgcacgcgctgtcgtgggcgctggacaacgtcgtgcggtgccacccggacgcgacgctcgtcgtcgttcacgcccagcacgccgccgaccacttcgcctaccccgtcgccgcgcacggtatcggcatcgtgtacgccccgtcctcggcggtggagtccgtgcgggcggcgcaggaggagagctcccgcagggtcgtggcgcgcgcgctggacatctgcaaggagaggcaggtggacgccacgggggccgtcgtggagggcgacgccaaggaggccatccgccaggccgtggagcgtatgcaggccgggcttctcgtcctcggcagccggggcctcggcgcgatcaaaagggcgttcctgggcagcgtgagcgactacctcatccatcacgcctgctgcccggtgctggtcgtcaggcccaggccgaccaag

SEQ ID NO: 5829 - DNA, 585 bp, Zea mays
atgaagaagaaagccgatgtgttctggattccgcagaggcggagtgtgcctacagcattcaagctcttcactggttctgcctggatggcactgtccaggccctttgtggaatactgcatatggggctgggacaacctacctcgcacagtgctcatgtactactcaaacttcatctcgtcgccggaaggatacttccacaccgttgtgtgcaacgcggaggagttcaagaacacgacggtgaaccacgacctgcactacatctcgtgggacaaccctccgaagcagcacccgcactacttgacggcggaggacctggaccgcatggtcgccagcgacgcgccgttcgcccgcaagttccacgaggacgacccggtgctggacaggatagacgaggagatcctgggccgcggcgcggacgtgccgactcccgggggctggtgcgctgggacgcgggagaacgggagcgacccttgctcggtggtcggagacaccgggcttgttgtgcctggccgtggagccgcgcggctgcagcggctggtcacgtcgttgctgtcggaggagaagttccacccaaggcagtgcaag

SEQ ID NO: 5830 - DNA, 216 bp, Zea mays
atgagattgttgaatgccaacttttcgactgcaaatgcaccaaggggaaatatgggtagactaaggcaacacattagcagtggccagtctcgcaatgatgtagcattaaaccaaaagccagatcttattaataagccatacttcatcaggttctcaataatgagcctgctattcaccgcaaccagaacaacaatacataggttgaaaaggcctgca

SEQ ID NO: 5831 - DNA, 306 bp, Zea mays
atgtggttgcagccgtggttcttctcgatggggcggcggcacatggggcagcgcttggtgttggccaccacccagttggccgtctccgagtcggacgcgttcttggccagccacgcgcgcaccgtgccgcacgacacgggccggtgcgcctcctcgccgcagcgccagcagaaggcgtgcctgcacccgcagacgacgtcgaccgcggaggccacggcctccgcgtcgcagccgccgaggagctccacggaccgggtgcagccggcgccgccgcaccacctgatccggcccccgctctcctccacg

SEQ ID NO: 5832 - DNA, 273 bp, Zea mays
atggccatggcgacgagcagcgcccaggtggtccactcgggcagcagcgtgaaccagaaggcggtgagtacggcgacggcgacgagcgcggcctggtggagcgcgatggggacggaggccgggaccagcgcggcgagcgcgagcgcccccgcggcgttgggcaggaggagcgcgaaggagacggcgtcgagcgggaggcggaggcgggagaggaggaggagcgcgacctggccgccgaggacgaggaggacggagagcgcggagaagccgagg

SEQ ID NO: 5833 - DNA, 786 bp, Zea mays
atggggaggtctccgtgctgcgagaaggcacacacgaacaagggcgcctggaccaaggaggaggaccagcgcctgatcgcctacatcagggcgcacggcgaggggagctggcgctcgctgcccaaggccgcgggactcctccgctgcggcaagagctgcaggctccgctggatgaactacctccgcccggacctcaagcgcggcaacttcaccggcgacgacgacgagctcatcatcaagctccacgccctgctcggcaacaagtggtcgctcatcgcggggcagctgcccggccggacggacaacgagatcaagaactactggaacacgcacatcaagcgcaagctgctcagccgcggcatcgacccgcagacgcaccgcccgctcagcggcggcgcgggcagcgcgctcaccaccacgtccagcaccgccggcttcccgtcccccgcgccggcgtccaggcccacgcccacgcccccgcccgccgtcgtcgtcccgcccaatgcgatcttcgcgcgcccggcgccgtcggaggacggccacagcagcagcggcgcgagcacggacgcgccgcgctgccccgacctcaacctggacctggacctgtccgtgggcccgccgcccaagacgccggcggccacgcccgcgtcgcagcagcggcggcggacgaccatctgcctgtgctaccacctcggtgtccgcggcggcgaggcctgcagctgcgagaccgcgtcgtcgctggcgggcttccggtttctccggccgctggaggagggccagtacata

SEQ ID NO: 5834 - DNA, 672 bp, Zea mays
atggcagccgtccggtccgacagggtccaccaccaccaccgccgctccgaggcgtcgtgcccggcaacctccgcggccgtggcggcggcgagggccgatgacgccctgcgccagcgcccgcgggggctcgtgcaggtccgggagcgggatcagggcccgctgtcgacggggcaccagcacctgcaccaccatcaccaccagctgcggcggtcggcggcgttcccaccccgccgcccggggccggggcgccgccctcctcagcgctgcgaaagcgacctcaacatcagggagcaccgctcctgcagcgaggtggccggcggcaccgcggcgggctgcgccgctgtgtgctgctgcttcccctgcgtcatggtggaggtcgcggtgctcgccacggtgcgcgcgcccgcggcgctgtgccgcaaggccgcccgcgtgcgcaagggccgcaggcgctctgcctccgcgggccaggccacggagatatacgagctcctcgtggacgacaccggcgtcgtcgaggtggatgccggcgccgccaatgcggtggcgctgcccgtgaagcccgccttgcagctggaggaaaagggggagctggagaaggaggtgtgggcgaggttctacggcaccggcttttggaggagcccgtcgcagctggacgacaacgacgacagg

SEQ ID NO: 5835 - DNA, 225 bp, Zea mays
atggcggcaacatcgagggcatcgcggtcaacttcacgcagccgcagccgagctactcggccttcagggaggccagcttcggccacgccaccttggagatcaggaaccggacacacgcatactacgcctggcaccgcaaccaggacggcgccaaggtcgtcgccgacggcgtctggctcactaacaggtactggatgcccaccgacgacgacatcaactgatgag

SEQ ID NO: 5836 - DNA, 321 bp, Zea mays
atggccatgtactctagcatttttggtggaattacaacaaacccttctgcaatggtgataccaatcgatgatcacatggttcatagaggtcatggggtttttgatactgcagctattatggatggtcacctctatgagttagaacaacaccttgaccgcttcctgaagtctgcatcgatggccaaaataccattacctttcaatcgctcaacaattagaagcatacttattcagactgtgagtgcatcaaattgcacccaaggatcactcagatactggttgtctgctggacctggagacttccagttattttcatctggc

SEQ ID NO: 5837 - DNA, 153 bp, Zea mays
atgatgagcgcgacctcggcgtcgcacagcagcgacagctcgtacgccttcttgagcagcccgttcctgcgcttggcgaacgtcacctgccggctgatcttgttctcgatccgcttcagctccaccttgccgcgacccatcttccctgctagc

SEQ ID NO: 5838 - DNA, 579 bp, Zea mays
atggccatcgcttgtcggatggaatgcaccccttccgtttcctccagaaggcctttatctcgcaagaagcgcggggcgttcagcctcttcagggcgatgtcctggtccttcggccggagcggcgacagcatgaagaagacagacgtcgacaccacgagccccaagaagagagccatcgcggctgctgatgacgattgcaagcctgccgatgacgagtcaacgtcgtggaagcgcctcgtggacggtatgcgcccgctccgcctccgcgggcagctggagtactacccgccgccaccgccgccaccgccgctgggccacgccgatgtgtaccatgacgtgatcctcccgccgccgtcgcaggcacggttcggcttcgagatcaaggaggtgggcatgaccagccgctacgcgtccgctgaggatctgcaccagatggacagcgaccaggaagagggtgctgagggtggcgatgacggtgacagcagttgcccacacgccatcgacatgcaggcggaggagttcatcaccaagttctatgagcagttcaagtcagaatcgttcaacggccgtgcctccgag

SEQ ID NO: 5839 - DNA, 237 bp, Zea mays
atgcgttgccggggtgggtgtcgagcggggcgtgttctggggccgtgggcttggggggggcaccgaggctttggaggtttggaggcgtcttgcggcctccaagaggtgtgtttcaggggtcagcgtggcgcggcatgtgcgcgggccggcggtgtttcggtgcgtgcgggtgacgtccgtggacgacggcggcggcggcggcggcaccaaacgggaaggtcgggtaccaggcggcgg

SEQ ID NO: 5840 - DNA, 747 bp, Zea mays
  misc_feature (384)..(503): n = any nucleotide
atgagtaaagggaggggggggaggggggggggaaaggaggagggagtgatggagaggagtgagggagagaggggggagggaagagtaaagaagaaggaagaaatagaaagggtagatatgttaagagtgacttatggttggaaatgtaaaaagacgaaacagaaagataataaggggcagagagggaagggggggggggggcggagtaagggaggggtagtaggtagagggcgagggaggtggagaggaaggagaggggagagagaaagaaaggggagagaggagaagggagagagcggagagagggagagagtgggcgtacagagaaggcaaaggagagcggatccaggcctgcggagtggtaaagtagtgtggaggggattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacgcgtccgctgccatcattcgagtcttccctggttgcggctgcacagggactcgatggcgtcctcctccctcccggcgcccgcggccggccgcgccgagctcctcaaggccttcgacgacgcccgcacgggcgtgcgaggcctcgtggagtcgggcgtctcgtccgtcccggagctcttccgccacgcggacccctacgcctccatcccgctcgccccgcccggcgtttccatccccgtcg

SEQ ID NO: 5841 - DNA, 174 bp, Zea mays
atgtcggaggggactgccaactgcgtggacatcctgatcgccatcatcctgcctccgctgggggtgttcctcaagtacgggtgcggccacgagttctggatctgcctcctcctcaccttcctcggctacatccccggcatcatctacgccatctacgccatcaccaagaacacc

SEQ ID NO: 5842 - DNA, 240 bp, Zea mays
atgagactcttgcattttgtagctaatgctgagctctattgcaagcttggcttgccatttgtgatgggcacaactggtgggaacaagcatttgctctacaagtcagtgcaagattcaaaaaattatgcactaatatctccacagatgggcaaacaagtgggtgcatttgttgctgctatgaaaatcatggctgagcagtttccaggggccttttcagggtatcatttaaaggtacaattc

SEQ ID NO: 5843 - DNA, 255 bp, Zea mays
atgcatcgtctactttttacattcccattggatcttgtgagacgtcgcatgcaattggaaggagcagccgggagggctcgcgtctaccagacaggactttttggaaccttcggacatattgtccgtacggagggttttagaggcatgtatagaggaatcttgcctgagtactgcaaagtggttcctggtgtcggcatcgtatttatgacatatgagatgcttaaggccatcctcacaggactggaatctgatgat

SEQ ID NO: 5844 - DNA, 531 bp, Zea mays
atggcgcgcgtgcgcgagccaccgctgatggcatctaacgacgactccgcgtcgctcttggtcgactacggatggtctccagcagcagccgcccctgctaggtcgtctcctttgcggcggctccttcacggcgggaaggcgacgacgaggccggccggcgccgccgccgccgccgccgccgccaccaccaccaccaccaggagccacgacgtcaagaggttcatatgctcgcctttcgcggctgtcttccgggcgatgtcgtgcgcgcgtgattctgctgtcagtacatgcgaccgaccagcggagcaggtcatccaccgccggggcggcccaccgcccttccccaggccaggaacgacgctacccaccccttcacccgcttctctaccaaggtacaagcccgccccaccagtcccgtcccgcccgcccacgaacattcataccagcagcgtgggtaataccaccgccaaccccctcccctccccccgaagggttttactctcattctttgtgctctttaaaattgttcat

SEQ ID NO: 5845 - DNA, 423 bp, Zea mays
atgtccttctacaccacggaggagcaggcctacgagctcttctcccgcgctggcgagatcaagaagatcatcatggggctcgacaagaactctaagaccccatgcggtttctgcttcgtactgtactactccagggaggatgctgaagatgctgtcaaatacatcagtggaacgatgcttgacgatcgtccaatccgtgttgatttcgattggggctttgaagaaggcaggcaatggggccgtggacgaagtggtggacaagtgagagatgagtaccgtacagattatgatcctggtagaggtggttacggcaagatggttcacagggaactagaagcaccaagagaactagttgactatggtggatctttccaaccaaatgcaccacctccctatgaaaaatgttaccggaacacagacact

SEQ ID NO: 5846 - DNA, 744 bp, Zea mays
atgagaggtaagaagaagagaaagtcgcagcacacggccgtgagacgcaaaaggcagacgaaaccagcaagggggatggaatggtgggggtttcgattacataaagcacgagagcacggggcgagggggatcgttccacccgacacggggaaagagccctcaaacatgcttattggacgagcaatttcttggccaaaggtgtcggacttcgggctgtccaagaacggcccgtggatgaaccagctgcacgtgagcaccgccgtgaagggcagcttcgggtacctggacccggagtacttccggtgccagcagctgacggacaagtcggacgtgtactccttcggcgtggtgctgctggaggcgctgtgcgcgcggcccccaatcgacccgcagctgccccgcgagcaggtcagcctggcggagtggggcatgcagtggaagcgcaagggcatcatcgagaagatcatggaccccacgctcgccggcaccgtcaacccggagtcgctcgccaagttcgccgagaccgccgagaagtgcctcgccgagttcggcagtgaccgcatctccatgggcgacgtgctgtggaacctcgagtatgcgctgcagctgcaggacgccaacccgcccgagggcgaggacagcgacggcaacagcgacggtgccacggcggagggcggcgccatcgtccccgctggcggtgccgtgcccgacgcgtccaccgccgccgccggggagctcttccag

SEQ ID NO: 5847 - DNA, 522 bp, Zea mays
atggtggtgcagaagcagaggagggtgccggccgaggtgttctggcctaaggtcgtgctcaagaagtggctcaacctcaagagcaaggacctggacttgggcgcctccttggccgccgattacgacgacgacgacgacggtagcgacgttgacggccaagagaactgcggctgtgacgacggcggcggcggcggcggcgctcgcaggccggacgatgacggcgacggcgcccagatcaccgacgatagcctggagagcgcgccgtacaagctgcggcggcggaactcggagacgctgcgcgcgcagtacatcaacaccaaagagctgagggtctgcgtcggcacctggaacgccggcggcaaggcgccgcccaacgacctctacatcgccgagtggctcggcactggaggcgacgccgaccccgccgacatctacccgctcgggattaagaaagtggcgctcgttcactgcctctacagcgtgccgcacgttcgacgtattcacgtggccgacaccgtgaat

SEQ ID NO: 5848 - DNA, 228 bp, Zea mays
atggtgtcgcgtcggcagtcgcccgacgctcaccggtcagctgaaacacccgcaccgcgcacagcgccggcatccgaatccgccggccccgcccgtccacctttgtgtgccggtctttggacggccgcttggccaccacgggccccgccgccgcgggggctgccggtacgagcgccttcttgtcgccgcccgcggccggcgacggctggggctgctccgggacgggcg

SEQ ID NO: 5849 - DNA, 273 bp, Zea mays
atgctgcaacacccacatcatgccaaggtcgcaccaaaattctgtaaacaatttggtaacgtgggcgatgtcatcaacaaggcgctatcagagtcaaggcaagaagtggaggctcaggctttccctggtccaagccacacaccgtataagataactcccacagatgttgacggctttgcagatgcactgcagaagatgggtttgagtgacgccgcagatgccgcagccgccgctgctgaaaacagggagaaaggtggagaaccaaaaggagag

SEQ ID NO: 5850 - DNA, 636 bp, Zea mays
atggagcagaaggttctcgtcgccgtgggcgtggccgtgctactcgtcgtcgtcctctccaagctcaagtctgtgctcgtcaccaagccgaagcttaacctgcccccagggccatggacgctaccattaataggtagcacccaccacctggtcaccagcccgtcgatctaccgggcgatgcgtgatctcgcgcaaaagtacgggccgctgatgatgctccggctgggcgaggtgcccacgttggtggtgtcgtcgccggaggccgcgcaggcgatcacgaagacgcacgacatcgcgttcgccgaccgtcacatgaacaccaccatcggcgtgctcaccttcaacggcaccgacctggtgttcggtccctacggcgagcggtggcggcagctccgcaagatctgcgtgctggagctgttcagcgtggcgcgcgtgcagtcgttccagcgcatccgcgaggaggaggtggcgcggttcatgcatagcctcgcggcgtccgccggcaccgtgaacctgtcgaagatgatctcgagattcatcaacgacaccttcgtgagggagtgcattggaagccggtgcaagtaccaggacaagtacctggacgccttcacaccgcggtccggcagacgtcggcgc

SEQ ID NO: 5851 - DNA, 318 bp, Zea mays
atgggcaccggctcttgttctgccctttgcctgttcttgccgagcgacgcgcgcttactgctcccgggctggttgtgcttggaggaggtggaagacgacgcggcgcgcttgcggctgctgctgcggaggaggacgtcgggcgcggcggcggggtccctggcgacgtggcggatgtcgtggcgacgtggtccgagcggcggcgaggcgtcggacgcggcgtcgacctgcacctgcacgatggggtcgcccttgagcacggcctcgacggcggcctggcacgcctgccactggcccgaccagagcaggccgacggagccg

SEQ ID NO: 5852 - DNA, 522 bp, Zea mays
atgaaggttttatactccggcttttccgaagggttcaccggaagaggtttcagccaggacagagagggtatcgatctcctaggaaattcatttcaggtcgatactgtggcttaccatctctcagttctgaaggatctgttcccacaaggcataaatgtgctgtctttattctctggtattggagaagcagaggtggctctccacaggcttggcatacagatgaacacggttatttcagtggagaagtccgaggtcaaccggacgattctgaagagttggtgggatcagacgcagacgggtactctgattgagatcactgatgtgcagacactgtcatctgagaggatcgaggcgtatattagaagaattgggggcttcgatcttgtgattggtggaagtccctgtaacaacctcactgggagcaaccgtcaccacagagatggtttggagggcgagcattctgcattgttccatcattattttaggatcttacacgccgtcaagtccatcatggagcgtttg

SEQ ID NO: 5853 - DNA, 504 bp, Zea mays
atgcagagggtgttctcgcgcatcgacgcggacggcgacgggcggatctcgccgtcggagctggcggcggtgtcgcgcgccatctccccgccggcgagctcctcgcacgggcggcgcgaggtggcggccatgatggacgagctggacacggaccgcgacggcttcgtggacctgggcgagttcagggcgttccacgcgcgcggcgttggcggcggcggggacgacggcgacgacgcggagctccgcgccgccttcgccgtgtacgacgccgacggcgacgggcgcatcacggcggccgagctgggcagcgtgctcgcccgcatcggcgaggggtgcagcgccgaggagtgccgccggatgatcgccggcgtcgacgccgacggcgacggctgcgtcgggttcgaggagttcaagatcatgatgcgcggcccccagccccagccccagcctcagcctcaggccggcgccggagtgacagccgtgccggacaaggccaagaaggag

SEQ ID NO: 5854 - DNA, 429 bp, Zea mays
atggcgatggcttacaagatggcgacggaggggatggacgtgaaggaggagtgccagcgctggttcatggagatgaagtggaagaaggtgcaccgcttcgtggtgtacaggatcgacgagcggtcgcgcgccgtgctggtggacagggtgggcggccccggggaggggtacgaggagctcgtggccgcgctgccaggtgacgactgccgctacgccgtcttcgacttcgacttcgtcagcgtcgacaactgccagaagagcaagatcttcttcatcgcctggtcaccggcggcgtcgaggatacgggccaagatcctgtacgcgacgtcgaagcagggcctgcggcggctgctggacggggtgcactacgaggtgcaggccaccgacccctccgagatgggcttcgacgtcatcagaggccgcgcgcaa

SEQ ID NO: 5855 - DNA, 573 bp, Zea mays
  misc_feature (77)..(77): n = any nucleotide
  misc_feature (203)..(203): n = any nucleotide
atggcgttccccgccagggtctctacccgggtgggcaacgagctgggcgccgggaagcccccggcgcgcccggatgncggcgctggtggcgctgtggtgcgcgctggcggtcggcgtgctgcacgtggcgtggacggtggcgctgagcaggcggtgggtggagctgttcacggcggatcccggcgtggtgcggctggcgtcgncggcgatgcccgtggtggggctgtgcgagctgggcaactgcccgcagacggcgggctgcggggtgctccggggcacggcgcgcccggccgtgggcgcccgcatcaacctcctctccttctacctggtgggcacccccgtggcggtgtacctggcgttcggcgcccgcgccgggttccgcggcctctggtacggcctcctgtcggcgcaggccacgtgcgtggcgctcgtcctcgtcgccgtcgtctggcgcacggactggcgcgtcgaggccatgcgcgccaagaagctggcggggctggagctcaccaacgacgccgaggaggagagcaggcgcctcgtggccgccaccggcgagcaggcggaggatac

SEQ ID NO: 5856 - DNA, 165 bp, Zea mays
atgccggcggtgtcggtggccaacgaccagcagtacgtggtagtggcggcggtcatcaccgtgcttgtggacccgcactcgctgtcgtgcaccgacgcgctccagcggtcgagcctggcgccccaggggcacgccgcgggcgcgctggtctgcgactggcaacgc

SEQ ID NO: 5857 - DNA, 351 bp, Zea mays
atgagcaaggagaagcaccaccgcgactggatcctccggcgctgctgcggctccatcgccgcctgcatcctgacgctggccgtcgtcgtaggcttcatcgtgctcgtcatctacctggcgctgcgcccctccaagccgtccttctacctgcaggacgtgcagctgcgctccatcgacctcagcgacccggcgctctccctcgacctccaggtgacgatcgcgtcgcggaacccgaacgagcgggtgggcgtgtactacaagacgctggacgcgctcaaccaccgtaccgcgacgaggcggcgaccggtacccgtgtcgaggcccggcgatctaccagggccaacaaggacg

SEQ ID NO: 5858 - DNA, 639 bp, Zea mays
atggggccgggtcaaggtcgtggggttgcggcactctgggggaggtactgggagcgcttgctcggcgcgggcagggcctccacaatcgtcgtgtacacgctggtgctgtcgtgggtgtccgacgtggcgcgggcccacagcagtgcccgccgcgctatactggatccatccggccaccgtgctcaccgtctacctgcacttcttccgcgccacggacggcgtcgacgcggccgtcgccgcggcgggcggcgacccgtgggcgggcgtccggttcccgggcctcccgccgctccgcgtccgcgacctgcagtcgttcatggtctccacctccgaggacgacccctacgcgttggtcgccgacgcgttccagcgagctcgtcgggcggctggacgtcggcgaggacagccccagcgtgctggccaacacgttgtacgccgtggagcccgaggcggtggcgtcgctgcgggagcacggcgtggacgtggtccccgtcggccccgtcctctccttcctggacgacgacgcggcggccggcgacaacaacgacctgttcacgcaggacggcaagggatacctcgagtggctggacgcacaggcgccgggctccgtggtgtacatctcgttcgggagcctgtcgg

SEQ ID NO: 5859 - DNA, 588 bp, Zea mays
atgtctcaaatccaaagcttctcgcggaacaactgtgtgctccttgtggtgctgtgtgggaagtatgctgagaagcgagcaccagcagcgaagtctgggctggaggcgaagcggccacggccgtcttacccattcccggagctcagctcagctgggcgattggaggtccacacactgtttaatcctacaccagagcagttcctcgaggcgcagcgggtggtgcagcccaacttcttgtacatccagggtcagcagcttgaggatgagaaggagattggctcacttgtgtggggggacgccgatgtctctgatccgcaggcgtttagcactcttatcagcccaccattcccaacgatagtatatctggaagttcctattggtgaaaaacttgcccaagcagttcactcaaaggggatcccatatgtaatttactggagaaattcattctcgtcttatgccgcatctcattttcgccatgcattgatgtcagtacttcaaagttcggtgagccatacttgggatgcttctcagcttggtcacgcatcctttcctctatattgggcaacaaaccatcatgtcccaaagcgt

SEQ ID NO: 5860 - DNA, 168 bp, Zea mays
atgcttcagaaattgttctgtgagcctgacaaagtgccgcagtggcctgatcgtatctttctgccagcgcacggtatgctcgatagaattcctccacaaatttcattagctctgaacgtttcttgtagtacatctctgctctccttgcaaaagaatcagcatcttcat

SEQ ID NO: 5861 - DNA, 432 bp, Zea mays
atgccgaagccgccgccgccgagggccaggtgcggcactggaccgcggacgtcaacggcatttccctccacgtcgccgagcgcggcgccgccgacgcgccggcggtcctcctcatccacggcttcccggagctctggctctcgtggcgccaccagatggccgcgctcgccgcccgcggcttccgcgcgctggctcccgacctccgtggctacggcgactcgtctgtgcccaccgaccccgccgcctactccatcctccacctcgtcggcgacttggtcgcgctccttgaccacctccaactcacaaaggtgttcgtggttgggcacgactggggcgcgatggtggcgtggcacctctgcctgttccggccggaccgggtgcgcgccgctgttgtcctggggatcccctacttcccccgcggccctcgcccga

SEQ ID NO: 5862 - DNA, 495 bp, Zea mays
atggtgaagacggcggcgagcagcagcagcgacgacgccgccgccgccaagaggaggacgtacaagggcgtgcggatgcggagctggggctcgtgggtgtcggaggtgcgagcgcccggccagaagacgcggatatggctcggctcccacgccaccgccgaggccgcggcgcgcgcgcacgacgccgcgctgctctgcctccggggctcggcggccgacctcaacttcccgctccgactcccgttcgacctgccccccgcggccaccatgtcgcccaaagccattcagcgcgtggccgccgccgccggcagcgccttcttctcctcctcctgcggcggtggcggcggcttgcccgcgccgccgacctttcggccacgccccgagaacaacggcccccgtgccatgaaaccaccgcgaacggttacgccccctccctgcgttttaccccccactcgtttaacctcccagccccccccgaccaacgtctcctctccc

SEQ ID NO: 5863 - DNA, 231 bp, Zea mays
  misc_feature (34)..(34): n = any nucleotide
atgtcgtcagcccacgcgtccgatttcgacgcancctcctccctctttaccgcggcgtgcacgcgtgcggagggcgcggatggcaccggcctcctccgcctccgcctccgcctccgcctcccccgttttcgtctgtgcctaaacccctgccccagcccgagggctgagcacgcacccggccctgacctcgagccccgtattcttgaggtcttcgtcgtgcacccccgcctg

SEQ ID NO: 5864 - DNA, 291 bp, Zea mays
atggagatgctgagcatgctgaaggtggggtacaccatcctgcgcagcgagacgcccgcgacagacctcgtcaacaccttcatggactgggcggcgcgcaggtcccttatgctcctggccatcttcctcccgccgtactacatctacaagctcaccacgtctgcgttcgctgctgccgtgccagaggacgtcgcagggaaggttgtgctcatcaccggcgccgcctccggcatcggccaggtatgccaaccagtaactcctttgtgtacgcgtatttttgctgaaacaaac

SEQ ID NO: 5865 - DNA, 270 bp, Zea mays
atggagcttcttttttgtttttcactgtgttttgggttgctgttggatgtgcctgttgcaagttgcaaaagagaaaaggcaatgatggtgtcccgtaccaacagcttgagatgggaggtcaggcaccaaactcttcgggggtggacaacaccgcaagcacaacagatggctgggaagacggctgggacgatgactgggatgatgaagaagcaccggcaggacctgtggataaaaagcctacgggcagtgtctcagcaaatggcctttcgt

SEQ ID NO: 5866 - DNA, 621 bp, Zea mays
  misc_feature (405)..(553): n = any nucleotide
atgatggagagggtcgaggacttagggctcagcctcagcctcagctcgtccctcgcgtctcctcgcactcaccatgtcgccaccatgctgctacgcgctccagcggcagaaggcagccttggcgcagcagctaggcctgcggccccgccaggtggaggtgtggttccagaacaggcgcgccaggacgaagctgaagcagacggaggtggactgcgagtacctgaagcgctgctgcgagacgctgacggaggagaaccggcggctgcagaaggaggtgcaggagctccgcgcgctcaagctcgtgtcgccgcacctctacatgcacatgtccccgcccaccaccctcaccatgtgcccctcctgcgagcgcgtctcctcgcccaacgggaactccgtagctgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggaatcttggggcaagagaactcttactttctgggggggtggacattaattggggaccaacctacc

SEQ ID NO: 5867 - DNA, 351 bp, Zea mays
atggaatcattttttttagattggacaggttgtttccatttctccgagagcaaagaaccttggaagcagcccagaaatacgcccataccaaacttaatctgcccaaagaggtatcccacggcggttttatacttgaaaggattgatggtcgatggtccacaggccatctggtcctcacagacactgatgtccggaacaatccagcagttaccttcaactacttcagtcatccacaggatctcaatcgctgtatctatggtatcaagaccattgaaaggatactcaagacaaaccgtttctctgaactctctgctgatggtgctgggttatcgatggaaagggtgctcaata

SEQ ID NO: 5868 - DNA, 447 bp, Zea mays
  misc_feature (424)..(424): n = any nucleotide
atggcgggttggtgcgagcaggcggtggcgctgctacagcgccccgcggtggcggagatggccgtcgacgtgctgctctgcgcggtgccgatctgggccgccgtcatgatcggcctcgtcgtcggctggtcctggcgcccgcgctggacgggactgctcttcctcggcctccggagccgcctccgcatcctctgggtgccgccaggcctcggggcccggcggctctggttcgcctgcaccgcgctctccgcctgctccgtcgcgaccaagctcatctcctccgcattccgccgctgcagaggcaagcaccaggacagggcctcccccgacgatgatgccgctgcgaccagagacggcggatgtcgcgccgacggcagaacaaattttgagggtgagcatgatacagtcactgagaacgacctanaacatctcctgcaactttttaga

SEQ ID NO: 5869 - DNA, 501 bp, Zea mays
atgttttctaggtgctctttgccttcttctgggttgtccattgtgattagaggttccgacttgtcatccacaacaagaactgcagcagctccagcattttgtgcattccatgccttggttgtgaagaaacattctccgcggtcgacgaggacgaagatgggtcgtcccccagcctgcttgggcttgaacgagatgtcgaactggtcgaagctctggcacgccttccggttggacttggggtactcgacccatccgtgcagggtgcccccgtactgcggcaccccgaagttgccgatggcgcactcgtacttgcccttgagctcgtcgggggaggtcacctcgaggctgttcttctccaccacgaacctccccgccgccgcgtccgccaaggccagcgccaccacgaccagcagcgccagccacgcctgccccctcatcatggctcccttctgccccgatcgcaccgctctgctacagaccctcagcgcccagtggagttgc

SEQ ID NO: 5870 - DNA, 660 bp, Zea mays
atgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcgtactacgactacatcatcgtgggcggcggcacggccgggtgcccgctggccgccacgctgtcggagcgcttccgcgtgctgctgctggagcgcggcgcctcgccctacgacgacgaccgcatcggggacatggcccgcttcgcggacacgctgtcggacacctccccgggctcgcccgcgcagcgcttcgtgtcggaggacggcgtcatcaactcgcgcccgcgggtgctgggcggcggcagctgcatcaacgccggcttctacacgcgggccagcgacgactacgtgcggggcgtcgggtgggacctgggcgccgccggggcggcgtaccggtgggtggaggacgtggtggcgttccagccggagctggggccctggcagggcgtgctgcagggaggtccgcttaacgccggggtcgagccgaacagcggacctacgctccgacacttcgccgtgttcctggtctgcgatttcatttttatactacaccgccgcgccggatttcgtctgcgcactgct

SEQ ID NO: 5871 - DNA, 636 bp, Zea mays
  misc_feature (518)..(518): n = any nucleotide
atggcaaacgcgccgaggatcctggccctcggcctgctagcgctcctgtgcgctgccgccggcccggccgccgcgcagaactgcggctgccagccaaacttctgctgcagcaagttcggctactgcggcacgaccgacgcctactgcggcgacgggtgccagtcgggcccgtgccgctcgggcggcggcggcggcggcggcggcggcggaggcggcggaggcagtggcggtgcgaacgtggctaatgtggtcaccgacgcgttcttcaacggcatcaagaaccaggccgggagcgggtgcgagggcaagaacttctacacccggagcgcgttcctgagcgccgtcaacgcgtacccgggcttcgcccatggcgggacggaggtggagggcaagcgcgagatcgccgccttcttcgcgcacgtcacgcacgagaccggacatttctgctacatcagcgagatcaacaagagcaacgcctactgcgacgcgagcaacaggcagtggccgtgcgcggcggngcagaagtactacgggcgcggcccgctgcagatctcgtggaactacaactacgggcccgccgggagggacatcggcttcaacgggctcgccgaccccacagggtggcgcaggacgccg

SEQ ID NO: 5872 - DNA, 561 bp, Zea mays
atggtggcagggctcatgaacgaacggctcaaggccctcaccacctcctttgcgcagcagatgggcagggagttccactactgcatcaagaacatggaccgggagtggaacactgccttcaatttctcttccgatcccgccttcctgacagcctgcatgaaggaaaccgacggtgacctaccgcagcgcgtgtgcacggccgcagagatgaagttctacttcgagagcttcctcgaaggcaacggaaggaagaactacgtgagaccgaacaagaactgcaaccttacttcatggatcgacgggtgtgagcctggatggtcctgcagcgccggcaaggaccaggaggtcaacttaaaagacgccgtcaacatcccgtccagaacccttgactgccgaggttgctgtgctggcttcttttgccctcatgggctcacttgcatgataccatgtgctctgggagcctactgccctcagtccactctgaataaaacaactggaatctgtgatccctaccactatcaaccacctgcccggaagcccaatcacacctgtgggcgacgc

SEQ ID NO: 5873 - DNA, 465 bp, Zea mays
atggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcagcggccgtggaggcggcggcggtgggtacggtggtggccgtggaggcggcggctacggcggtggcggccgccgtgatggcggtggcggctacggcggtggcggcggctatggtggcggcggcggctacggtggtggtggcggcggctacggcggtggcaaccgtggcggcggctacggcaactccgacgggaactggaggaac

SEQ ID NO: 5874 - DNA, 435 bp, Zea mays
atgcgccccgacgtgaagcgggacagcttctcgcagcaggagaaggacgccatcgtcggcctccatgagatcctgggcaacaggtacgttacacacacaacacaatgcgtttcggattggtttccttacccaccaggcagcagccagcgcaacgtttgctcggcgaccggcacgtactctgttaacgggcggcggcgtccatgtgtttttttttcggacgcagatggtcgcagatcgcgtcgcacttgccgggccgaacggacaacgagatcaagaacttctggaacagctgcctcaagaagaagctgcgccagcgcggcatcgaccccagcacccacaagcccatctccgccgacgcggcggcattggagcagccggcgtcgcgagaccgcaagccgtcgttggccacagccgccgctggtggcggcctcgatg

SEQ ID NO: 5875 - DNA, 234 bp, Zea mays
atgacgaactcgaaggcccagctcatgtacccgccggcgcagccgatggccttggtgtcgcagtccaccagctcctgctccgacagggacaccagcttcccgttcttgatctggttgatgccctcgatggccgcaacggcggagaacgcccagcaagagccacagtccccctggctcttcaccggcgcgacagctcccttctctcgccagtccacgcttttcggtagatcagaa

SEQ ID NO: 5876 - DNA, 264 bp, Zea mays
atggctgtgccgaggaaggggacggcgacgccactgggcgccgtattctcgcctgaggagaccaagggggccgtggcgagggtggccgaatccatcgctggtcgccgcgccgagctcgggcacctactgtgctttgtctccgactacgcggaccttgcttccttggtgaccaggctgccagtcgaacctcttccacgaaatcatggtccttaccttctatacctcaagttctctttggtggtgttgcttttgtccgcgggcgtt

SEQ ID NO: 5877 - DNA, 348 bp, Zea mays
atgctcttcgtctgttcaagtcagcaaaatgtagagtatcctatggttgatgaggctaagtttgaccagttcctttttagagtggaagaagctcttcaccatgagacgcaaggcagcacagatggacccaagaatcatgacagcggtagaggtgaccagagaagtaacagtgagatcactccattggacaccggtttgaccggccaaaatgagttcagtaacaacagcgaggaaggtctctttgacaagtttaaatttaggaaaggggtagggaggctctgcaggcaccctgtgtttcagctgagtaggtccatgaagaagtcagatgaagcggagcaagcatgtgta

SEQ ID NO: 5878 - DNA, 636 bp, Zea mays
atgacgggctcgaaacccgcgcccgccgcctcgcagaaccctagcgcggtcccgcatcgtcgtcctcctcctcctcctcctcctcctcctccgccgccggtgacagcggttgcgagggtgcgcgaagaaggcgagctctcctccggcgccgacgacgacgagactctgcaaactcagctaggtgccgcatccattcttgggaagtttgtggaggctggatctcaagtgccatcggcaagtctcctcggtaaaggcagtaacaccttgattgtctcaaatgctctgaatcataaagcgtctgctccaagttacaagaagatcatgagggtgaatcaggggcaattcaaacctggcactaaccggaatctttcatggcagaagcctgtgtcaagtgataaccttctgataactttctcagatgatgatagtggggcagactctgggaagacagggcgagataaagttaggaaggctagctctcaaggtacacagagaacagggaacagtatgcaaactacgatcatgagagaggaaggatctcagccaaaaaaccttggttcaaaaataggtgcctgcacacttggcctgcttttccattcacacatagaaaatgtgggggcccggcagggcatcagg

SEQ ID NO: 5879 - DNA, 705 bp, Zea mays
atggagcgcggcgactgccagttcacggtggtgccgccgcggcagtacgacgaggcccagttcatgcaccagctgatggtggccggcgaccagcaggaccccgcgggcgcggggcggggagctgccgccgccggcggggagaggaagcggcggttcacggaggagcaggtgcggtcgctggagacgacgttccacgcgcggcgcgccaagctggagccccgggagaaggcggagctggcgcgggagcttggcctgcagccgcgccaggtggccatctggttccagaataagcgtgcgcggtggcgctccaagcagctggagcatgactacgccgcgctcagggctcagttcgacgcgatgcacgcccgcgtcgagtcgctcaggcaggagaagatcgcgctcgccgcgcaggtagacgagctgcgggggaggctgaacgagcggcaagaccagagcggcagctgcgaggtcaacgacgcggaggcggcggcggacgacaagaggaacaatagcaccagctccctcgtgcaggacgacggcgccacgccgccgccggctgcagtagacgcctccgaggactcggcggcgaccggcgagtactacgaccacgtcgcgtacgagtacgatggcctgcacgaccccttcgtttgcgccactccggacctgtgggatacgtggccgctgctggagtggaacgcggtggcc

SEQ ID NO: 5880 - DNA, 429 bp, Zea mays
atggcgctgtccctctccctcgcgcgccccgcgcccctcgccgtttccgccggcgcaggagccaggaagctacccgcagccagcctcgcattcccggcgaaatccttcttcggcgcgccgctggccgccaccgcggcctccgtcgcgtcgccgctcccgcgcaagccggccacctccaccacctcgctcgaggtcgtcgcggcggggaagaagggctacaagatgaagacgcacaaggcgtcggcgaagcggttccgggtgacggggaggggcaagatcgtgcggcggtgcgccgggaagcagcacttgctcgccaagaagaacaccaagcgcaagaagaggctctcgaagatggtgcaagtcaacaagagtgactacgacaatgttacgggtgcactgccctacctcaaagtgaataggaaagcaaac

SEQ ID NO: 5881 - DNA, 555 bp, Zea mays
atgggtttagcttggactgctatgggtggttctactttgtacatcgaaacaacaaaagtggaggaaagggaagggaaaggtgaccttgtgctgacaggacagcttggagatgtaatgaaagagagtgctcagattgcgcacacagttggcagaactgtattactggagaaagagccagataatcatttttttgcaaactcgaaggtgcacttgcatgttccagcagggtccaccccaaaggatggccctagtgctggatgcaccatgataacgtctatgctgtcgttagctatgggaaagcctgtcaagaaggacctcgcaatgacgggtgaagtaacattaactggaagaatcctcccaattggcggggtgaaagagaagacgattgcggcaaggagaagtgcgataaagacgctcatatttccggcagcgaataaaagggactttgacgagcttgcttctaatgtgaaggaaggactggaagttcattttgttgacacatacagtgaaatatatgatttggctttccagagtgacgccgggactgagatgatt

SEQ ID NO: 5882 - DNA, 333 bp, Zea mays
atgccgcctcgacccataggcgacggcgggacgctcccgccgtcgagcagcccgggcggcggcttcagcggacggaccttgggttcgtcggccgtcttgggcgtcggcttcgaagccctgatcttgcccttctcgaagagctcgtcggccgtcgtaagcgtctcggccggtgcggccttgccgaactcgaattctgtggcccacgccgcctcgtccgcagccacggccccggccccggccccggccccgccaagtcccctcttcggcgtaccaggcctttcctcccagtcgaacggcacggacgacccgcccgcggcgtacgtccggcgcggc

SEQ ID NO: 5883 - DNA, 255 bp, Zea mays
atgaacggcatcaaccccaacggcgggttcctgtcgtacgggaacatggagagctacgcgatgtgggtggcgaccggcgtggcgtcggccttcttcgcgtccctcgagcgctgctcctgcatccacctccacaccgcggaggacgacggcgacgaggaggaggaggacctcgaggaggcccgccgctccttctcccgcccgatccctgagtactactacgaccggtccggctcctccgcctccgtcgccaagatg

SEQ ID NO: 5884 - DNA, 639 bp, Zea mays
  misc_feature (23)..(23): n = any nucleotide
  misc_feature (170)..(170): n = any nucleotide
atgaggagatctacctgcatctngctgccggtcaaggagcaccagatcgtggagaccctcgtcccggggctcaaggacgaggtgatgaagatcacgcccgtccagaagcagacccgcgccgggcagcgcacgcgtttcaagcccttcgtcgtcgtcggcgacggggacgnccacgtcgggctcggcgtcaagtgcgccaaggaggtcgccaccgccatccgtggcgccatcatcctggccaagctctcggtcgtgcccgtcaggaggggctactggggaaacaagatcggccagccgcacactgtgccctgcaaggtcaccggcaagtgcgggtccgtcaccgtgcgcatggtgccggcgcccagggggtccgggattgtcgctgcccgcgtgcccaagaaggtcctccagttcgccggcattgaagatgtctttacctcgtcccgtggctccaccaagacactcggtaacttcgtcaaggcaacctttgattgtctgatgaagacctacggcttcctcactcctgagttctgggccgagaccaagtatgccaagaccccgttccaggagttcaccgacctcttggctaagccgacaaagggtcttctgatcgaggctcccaccgagacagtggaagct

SEQ ID NO: 5885 - DNA, 522 bp, Zea mays
atggcggaggacgcccccaacgccgtcgccgagggcagccagcccgcggcctccgagggatccgccgacgccgccctgccggctgccgcgggcgccaaggccgcggaggcgctgctcccgtcgctcagtatctggccgccgtcgcagcgcacgcgcgacgccgtggtgcgccgcctcgtgcagacgctcgcggcgcccagcgtcctctcccagcgctacggtgccgtcccggagcccgaggccgagcgcgccgccgtggccgtcgaggccgaggccttcgccgccgcctccaagtccgccgccgccgccgccgagtgcccggcctccgtcgaggaggggatagaggtgctccaggcctactccaaggaggtcagccgccgcctcctcgagctcgccaagacccggtccgccgctgctgcggcggcgcccgcgcccgccgaggggagcgcgcaggcgcaggagtccgcggaggcctcgtcggcgactgctccacctaccgaggaggcttgcgtaaacgaagaa

SEQ ID NO: 5886 - DNA, 501 bp, Zea mays
atgacgggatctcggcaggaccggcctgctccttctccttgtttcccccagttgcccgctcgcgcgtcgtctttcgtcgtccagggaggtagttacagagatggcgagtgcactgatgcctccccgccgcgcgcgccgcggcggcctccgcgcctactccagcggtgcagggcgtgggtggagagagaccccgccgcctgccctccgcgccgaccgccgcctcccgccccctccgcgccgcgcacggcgggcacggcgcccgcctggaacaacaaacggcgggtggcggagggggaacggcggcgcggcggaccaagtggtcccgcactctcgcgaggtcacaatcgccggccgccgggccgggcgaccgccctggagcagcgcggcgacggggtccgtcttcagcggagcccaggcgcacggggtatggccggtcgccccagggcgcgtgggctggggcgcgcccttccgcgcccgacggggcatcgcgcgggggagagg

SEQ ID NO: 5887 - DNA, 678 bp, Zea mays
atggcgttgagcggcagagctctgctcttgttcaagctgctgctgctgctgctggcgtgcctgctcttcctcttggagctgtcccgaggcaaggaagaagcattcagcctgaggaacctcccgcccttccacaaggccagcagctaccccgcggggtgcccgacgacgtacgactacatcatcgtcggcggcggcaccgcggggtgcccgctggcggcgacgctgtcgcacaggtacagggtgctgctgctggagcgcggaggctccccgtacggcgaccgcaacgtctcctacatgcagaacttccacatcgggctcatgaacatggcgccggactcgccgacacaggccttcatctccaccgacggcgtcatcaatgcccgggccagggtgttggcccgtgcgacccgcctccatgcccgccttctcaccaccgcccaccccactctttatccaccagccccgcctggcataaacacccgccgaacaccccacccccctctcgtcataacccccctaccccccccccccacctccctccccccctcccacccccaccccccctccttcctcccactcacccacccccctctctcctctccccctcctaccaccccccccccccccctcctccttccttcccacaatcacctccctatacttcatacctttacttcc

SEQ ID NO: 5888 - DNA, 432 bp, Zea mays
atgaaacacatgtatcttgttgaaagttaccgtgcatatcacatactactgcaaaaaatgtctgaaaacaagtgccatggttgtataaaactgaaggagcatatatcattgatgagggagcaaaagatgtgcaaggatcagttgaatgaattgaaattccaaatgtccgacgaggcacttcaacaaatgccagagtttcaagccagaattgatgtactaaaggtaatccgttacattgattctgatctagttgtgcaacttaagggtcgggtagcatgtgaaatgaactccggtgaggagttaatatcaacagaatgtgtgtttgaagatcaattggatgacctagaacccgaagaagctgtggctattatgtctgcattcgtattacaacaacgcaatgcttcacaaccatctcttactccaacacacggt

SEQ ID NO: 5889 - DNA, 369 bp, Zea mays
atggaaacacttcttattcctctcccctcctgccatccattgcagcacgcgtgccaggtccctgcttcaagcggagcagttggcttgggcgaggtggcaccggccgggcaggctgttgatgatgcccatggtgctgcaggcgcactcgtgcgacacggcgctcagcgcgctgcagcagtccgcgctggggtccggcgcgccgggcaccaggtacgcgcggcacgccaggaggcggttcagctgcggcaggcactgcccgccggcctgcgccccggcgccgcgcagcaccgacgacgggccggtgccgccgccgaggaccagcaggacgaggcacgcggcgaggagtgcgcggggggcggtggctgcttc

SEQ ID NO: 5890 - DNA, 432 bp, Zea mays
atgggaccccgcggcgtcgccctagcgctcctcgcggcggcgctcctccaggccctcgcccccgcgtcggcggcggcggcggcggcggcggcggcggggggcctggtgcggctcgcgctgaagaagcagcccgtcgaccagaacgcccgcgtcgccgcgcgcctctccgctgaggagaggcagcgcctcctcctccgcggcgccaacgccctgtgctcggccggcggcgacgacgactccgacgtcatcgcgctcaataactacatgaacgcgcagcactttggggagatcggcgtcgggacgccgcccgcagaagttcaccgtcatcttcgacaccggcagctccaacctctgggcgccgtcctccaagagctatttctcgacagcttgctacttccactcgcgctaccagcacggcgcagccagtactta

SEQ ID NO: 5891 - DNA, 186 bp, Zea mays
atggcgtcgccggcgaggacgggcggcccgggtgcgagtgcaacagctgcttcggcgggccggactgctcccttcgcacgcccaactgcaccgccgacgccgacagcgggaacccgttgttcctggagccgtactggcggcgtcacgcggcggccagcgccgtggtgttctccgggtggcaccgca

SEQ ID NO: 5892 - DNA, 468 bp, Zea mays
atggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggcggcggcggctacggggccggcggcggctacggtgctgctggccgccgcctacagcggcgccaaccgcggcgacggcttaccgcaactccctccgcgaactggaggaac

SEQ ID NO: 5893 - DNA, 540 bp, Zea mays
atggcgtttccgaagcctactagtctagccgcgctagctgccttcgctgtggcggccatggcggcggcggcgatgatggccgccaccgcctcggcgcagaacacgccgcattttttcgtgaacctgcacaaccgcgcgcgcgcggcggacggcgtgggcccggtggcgtgggacgccagggtggccaggtacgcgcaggactacgcggcgaagcgcgccggggactgccggctggtgcactcgggcgggccgttcggcgagaacatcttctggggctcggcggggcgggcgtggagcgccgccgacgcgctgcggtcgtgggtggacgagaagaggaactaccacctgagcagcaacacctgcgaccccggcaaggtgtgcggccactacacgcaggtggtgtggcgcaggtccacccgcatcggctgcgcgcgcgtcgtctgcgccgccaaccgcggcgtcttcatcgtctgcagctacgaccccccgggcaacgtcaacggccagcgcccgttcctcaccctcgacgcggctgccaag

SEQ ID NO: 5894 - DNA, 579 bp, Zea mays
atggctgcggcagcggcgtccggaaggaggaagcggcggaggatgaggccagtgaagaacgaggaggaagtggagagccagcggatgatccacattgcggtggagcgcaaccgccgcaagcagatgaacgagcacctcgccgcgctccgctcactcatgccgccggcccacacgcaacggggcgatcaggcatccatcgtcggcggcgcgatcaacttcgtcaaggagctggagcagctgctgcagtcgctggaggcgcggaggcgttccccgcagtgcgctgcctacgccgtcgatcccgacgacgcggggccgttcgcggacttcctcaccttcccgcagtactcgatgtgcgccgtcattgcggccccagagaacactggccaccaccgtgagggcggcgccgtcgccgagcaggaggcgtccgggtcgaagccgtcggccgtggccgacgtcgaggcgacaatgggtggagagccacgccaacctgcgggtgctgtcccggcgccggccgaggcagctgctgcgcctggtgctgggggctccagggcccccgcctcaccgtggtccccctcaaca

SEQ ID NO: 5895 - DNA, 231 bp, Zea mays
atggatcattgggatcaacaccaggaagccaacgctaagtcagggtcaactgcactagcttctgccatagcagagtcagtcacagctgcagatcctgaagcaccaccctccattgacattgcaagtgcctgctgtagtaaatcgtcatcatcatgtggtcacagctatgtttgcagctatgggcgccctttcaataaccaacttcacgttgtaatgtgcagtttgcaggcc

SEQ ID NO: 5896 - DNA, 642 bp, Zea mays
atgcagggaggggcgacggccaagcagcaggcgcgagacggtgaccgcggcgcggcgaagacgccgacgacggaggggaagggcgacgccgccggcgccaaggctagcgccgacgtggcgaagggcgacgccgccgtcgccaaggctgctggggacgacgtcgtcgtagggaagggcgacgcaggcaacaaggccggcgccggggccatgcaccacggcctgtcggccgtggaggcgaaggactcccagaccatcgtcgcgctgcagtcgccggtgaccgtcatgcgccccgtccgcggcgacctcgaggagcacctccccaagccatatctggcgcgagccctggtggcgccggacatctaccaccccgacggcaccgcggccgacgagcacggcccaccaccacatgagcgtgttgccaacagcacgtccgccttcttgggaccgcgacgacaacgggcatcatctaccccttgggagacgtactcccggatgccgtgcgcttgggtacaacatgatcctgtctctcttgatcgctcttgtcgtgaacggacccatgagctatgccacgctgcctgggtggctgccgtcccctctgttcccgatctacgtccacaacatccacaagagcaagcatggcag

SEQ ID NO: 5897 - DNA, 552 bp, Zea mays
atgtatgcccgggcaaggttaaccataaaccctgacaaggtttaccggctggctatgacaaaactcaatacatctgctgccatccttgaagttatgggtgcgcccctaactggtactgatgtcagagcatatgttatgtctggaggaggcccgaaactgaaggacttcaaatttaagcttggcagtaaacggtgcttcctcattttccccatcaaaggatcagaaagaaggggcctcgtaagtgttgaggccaagaagaaaaatggacagtatgacatgaagctactagctgttgacataccaatggcatcaggtcctgaccagcggctgttcctcgtgggtgatgaacaagagtacaaggtcggcgggggcttgatatctgagctacgagacccgatcgtaaaagctatggccgcggagaaggagtttgactatcttgacgagagagaggatgaggaggacgagcggagggagcgtgaggaggcggagcaagaggaggcggaagcattgaggcgcgaggaggaaaggctgcgccaggcgggtgaaaaaccg

SEQ ID NO: 5898 - DNA, 753 bp, Zea mays
  misc_feature (127)..(127): n = any nucleotide
  misc_feature (315)..(315): n = any nucleotide
  misc_feature (466)..(466): n = any nucleotide
  misc_feature (586)..(586): n = any nucleotide
atgcggaagtggagtgaaagcaagcttggcaccgagttgcttcgtgctattgacaaggctggatatgaaaaaccatcaccaatccagatggctgccattccgctaggtctacagcagcgtgatgttnttggtattgctgagacaggttctggaaagactgcagcctttgtactccccatgttgtcttacattacccgattgccgcccataagtgaggagaatgaggctgagggtccctatgccgttgtgatggcacctactcgtgagcttgctcaacaaattgaggaggagactgtgaaatttgcaacctatctnggcatcaaagttgtctcaattgttggtggtcagtcaattgaggaacagggtttcaagattaggcagggctgtgagattgtaattgctacacctggtcggcttcttgattgcttggaaaggaggtatgctgttctcaaccagtgcaactatnttgtgctcgacgaggctgataggatgattgatatgggctttgagccgcaagttgttggtgtccttgacgcgatgccatcgagtaacttgaaacctgaaaatgaggatgaggaacttgatnagaagaggatttacaggactacttatatgttcagtgccaccatgcctcctgctgtggagcgtcttgctaggaagtacctccggaaaacccagttgtgtgacaattggtacagctggcaaggcccactgatctggatcaccccagaatgtgatcatggtgaaggagtc

SEQ ID NO: 5899 - DNA, 171 bp, Zea mays
atgtcatggcggacacacctgctattgaggcactgcataaaatggtccaagggaaatttagacaccttccagttgttgaaaatggtgaggttattgcgatgctggacattgcaaaatgtctgtatgatgcaatatcaagactggaaaaggcagcagagcaaggaagtgcac

SEQ ID NO: 5900 - DNA, 513 bp, Zea mays
atggtgaagtactcgcaggagccgggcaaccctaccaagtcggctaaggccatgggcagggatctgagggtccacttcaagaacacaagggagacagcctttgcgcttcgcaagttgtctttgaccaaggctaagcgataccttgaggatgttattgctcacaagcaggcaattcccttccggagatactgtgggggtgttggtcgcaccgcgcaagctaagtcgcgccactccaatgggcagggccgctggcccgttaaatcagccaggttcatcctggatttgctgaagaatgctgagagtaacgctgatgtgaaaggcttggatgtggacaacctctatgtttcacacatccaggtgaatcaagcccagaagcagaggcgccgcacctaccgtgctcacgggcgcatcaatccctacatgtcctcaccttgccacattgagctgatcttgtcagagaaggaagagcctgtgaagaaagaggctgacaacattgtcgcagcaaggaagcag

SEQ ID NO: 5901 - DNA, 1065 bp, Zea mays
  misc_feature (545)..(545): n = any nucleotide
atggtgctcaagttctccggctccggcaggcagtacaaggccgcggcggcgagcccgtcgttccggggcaaccgcttccaccgcaacagccgcctggccgcgtacacgggcgtcattgacgactcgggcttcacgtcggacggggccaccgagggctacggctacatgaggacgacgacgcacgcgaccggcgccaccgcgggaaccaaggtcggccgtggcttcccgcagcacgtcaggagcccgagcgcgagctggataccgagcatcggggaggaggacgatgaggaggatgaagaggttgtcgtcgttgaagaggaccgcgtgccgcgggagtggacggcccaggtggagcccggcgtccagatcaccttcgtctccaccgccggcggcgctggcaacgacataaagcgaatccgcttcagccgcgacatgttcaacaagtgggaggcgcagcggtggtggggagagaactacgaccgcgtggtggagctctacaacgtgcagacgttcagccggcagcagggcgtctcgacgccgacgtnctccatcgacgatgccacgcagagagactcgtcgttctactcccgcgccggctcgacgagggacagcccggtgatcctgccgtcgaagccgtgggcaggtagcaaccgatcgcccgcgccacctcgtgcagggcccacggccgcggcggccttcacggcccgagccgcgtgcaacccatcgtccagtgcggtgccggacccgtcggaccacgtgtgggcgcaccacttcaacctgctcaactccgcgccggcgccggcaccggccgctccgcacctcgacccgtcgcgcgctaccacgtcgtccctggacgaggcgtccgtgtccgtgagcaacgcgagcgacctggaggccacggagtgggtggagcaggacgagcccggcgtgtccatcaccatccgcgagttcggcgatggcacccgcgagctccgccgcgtccgcttcagccgggagaggttcggcgaggagagggccaaggtgtggtgggaccagaacaggaaccgaatacacgcgcagtacctg

SEQ ID NO: 5902 - DNA, 642 bp, Zea mays
  misc_feature (200)..(200): n = any nucleotide
atgagccccggcgccggtactgccaagaagcgtctcggcgttggcgccgtcgccggcggggggttcgcgctcgggtgcggctgcagggacgccaaggccgtggcggtggcggtggcatcgtcgtccgtgtcaccctactctgccgccaccagcgccacggagacgacgacatcgacggcgacgaccgcgacgtggcgcanggcgaggacgacgacgcacccgtcgtcggcgtccgggtccacgggcacgctcaccgtgccctccgcgtcgtcgtcgtccttcccgtgggaggacatggacgccgagggcgatggcgaggaggtggactgcaagagggagagctcggcggccacgacgagcttctccggcctgctgcgccagctcaacgagctcgagcagagcgtcgtgtcgttggggcggaagagcgccagcaaagatttacttgttcgcgccttcgccgccgccgttaccagcgcggtcattcagcgaagcaacgagctgtgcacagcgtggcggcgacagcaaagaaggtcacggcaacttctctccgccgccgcaggcgctgcgtcctttccagttccagactacgcagcagcaccggaagtcaaagagcatggacaaggacaaagcagcaagacaagt

SEQ ID NO: 5903 - DNA, 219 bp, Zea mays
atgatacaggctgctttcctgtatttcccagcaggaagctcaatccagttgccaccaacaatattgcaatcaatcatgaaacgaagggcaaaaagaatgttgctttcatatgtcagaaaactctttgaaccaaggccttcaattgttatgcccctttccaggataccacgacagctagcaaccatggtaggcagagcgactactatcttgaggaaaggt

SEQ ID NO: 5904 - DNA, 531 bp, Zea mays
atgggggcgatggcggcggctcgggggcagaaggcgctggtggctctgccgcagctggtgaagtcgctgcggagtgatcccgtttccggaagcgcacgactcagacaccttccgtctctcaggaggaccttctcgttgtacgaccagatcaacctcatcgacagcgtccccgaagacgagctccgattccagtcgtatgatgatactggattcaaaattaacaatataaaatatgaaggcagcttgttgattgtagagaacaagataatgacatgggcacccaaaacgttctcagagataactgctgaaagtttatcaatcttcaaagttgtgcaccctatcccagagatcttgattcttggttgtggaagacacatccagccggtcagtcctgagctacgaaagttcattcgttcaactggaatgaagctagaagcagtcgattcaaggaatgcggcttcaacatataatatcctgaacgaggagggcaggccggtggcagctgcagttcttccttatggagtcgcttgt

SEQ ID NO: 5905 - DNA, 369 bp, Zea mays
atgcagtcggctcagaggttacgagtgaggaagctgcagtacatcttggaggttgaacggagcgtcatcagtccccagatggaggtgtcggcgctgtcccttcgcgtggccttcatcgaccaccaccgttcaatgctcaccgtcggcaacaaccatctcaagcaaagaattgcggctctcgcccaggacaagatcttcaaagacgctcgccaagaggcggtggagaaggagatccagcgggtgcgccaagtgtaccagcagcagcaggtcaaggtggccaccaccggcggcgccgacatcgccaccgccgcctcgccgtcgatgcaggccaggcaagagctgctcgcgtgcgagggcgctgatattcga

SEQ ID NO: 5906 - DNA, 138 bp, Zea mays
atgaaatccagtgagtccaccaacaaaccagagagcaatgaaacaatatatcagaagccccaaagaagcgggagagtgtttgaaagccttccatactgttggataatcctcatccatgagaaacttgatgtacaaggc

SEQ ID NO: 5907 - DNA, 114 bp, Zea mays
atgagcttctccgtgagcgccttagggagccccattacactatcaattgtaccaacaatggcttccacgagaggtgaagttaaggggtgctccacaaggagaccaccagcgaca

SEQ ID NO: 5908 - DNA, 324 bp, Zea mays
atggatagcgttaaggtttcaattaatggtcatccaatctctgaaagagcccttaagaaggcagagaagaaagctggtcctgttgacccaggttcatattggtacgactaccgtgctggtttttggggtgtcatgggacgagaatgtatcggcattgtccctccatttattagagaatttaattatccgatggccagaaattgtgccggtggggattctggtgtttttgtcaatggcagagaactgcatcaaagagatttagatctacttgtaggaagaggactaccacggacatctggaaaatcatactctcttgagatggca

SEQ ID NO: 5909 - DNA, 240 bp, Zea mays
atgcagaacgaggagggtaagactgtggacctctatgtccccaggaagtgctcggccacaaacaggatcatcactgccaaggaccatgcctctgtccagatcaacattggccacttggatgcgaatggcctgtatgatggtcacttcacaacgtttgctctctctgggtttgtccgtgctcagggcgacgcagacagctccttggacaggctgtggcagaagaaggctgatatcaagcag

SEQ ID NO: 5910 - DNA, 378 bp, Zea mays
atggcggcggcggcagtttatggcggcctcaaggggaagcttggcgtcgaggatgcccccgagctgcagctgaatcgcatccgcatcaccctctcatccaagaacgtcaagaacctggagaaagtttgtgcggatttggtaaagggagccaaggataagcatctgagggttaaggggcctgtcaggatccctactaaggttctccacatcaccacccgcaaatccccttgcggtgaaggaacaaacacatgggaccggtttgagttccgcatccataagagggtgatcgacctgatcagctccccagacgtggtgaagcagatcacctctatcaccattgagccgggtgttgaggtcgaggtgaccgttgcagacgtg

SEQ ID NO: 5911 - DNA, 429 bp, Zea mays
atggtgcacgggaagctggaggtcctcctcgtctccgccaagggactcgaggacaccgatttcctcaataacatggaccccttcgtgatccttacctgccgcacccaagagcagaaaagcagcgtcgcaaatggagcaggaagcgagcccgaatggaacgagaccttcgtcttcaccgtctccgacgacaccccgcagctgcacctcaagatcatggacagcgacctcaccaacgacgatttcgtcggcgaagcaaccatccccctggaggccgtgtttcaggaaggcagccttcccccggcggttcacccggtcgtcaaggaggagaagtactgcggagaggtcaagctcgcgctcaccttcactccagcagcggaaactcgccgccctgatgacaacgaggaggggccgccttacagcagctggagt

SEQ ID NO: 5912 - DNA, 1158 bp, Zea mays
  misc_feature (803)..(803): n = any nucleotide
  misc_feature (899)..(899): n = any nucleotide
  misc_feature (902)..(902): n = any nucleotide
  misc_feature (953)..(953): n = any nucleotide
  misc_feature (983)..(983): n = any nucleotide
atgcatgcgaagatgacgaagcccgcagccatcgttgttgctgctatcgccgtcctctccgtcagcctgctggctgggtcgtcgtgccttgcccttgcgcggcccagcggcgacttctccatcgtgggctactcagaggaggacctgtcgtcgcacgagagcctggcggagctgttcgagcgctggctgtcccgccaccgcagggcgtacgccagcctggaggagaagctccggcggttccaggtgttcaaggacaacctgcaccacatcgacgagaccaaccgcaaggtgagcagctactggctgggcctcaacgagttcgccgacctcacgcacgacgagttcaaggccacctaccttggcctacggagcagtgttggcgatggtggtagtggtatcgatgacgacgacgagccggaggaggaggagggctacgagggtgtggacggggcgagcctccccaagtcggtggactggcggagcaagggcgcggtgacgggggtaaagaaccagggccagtgcggcagctgctggagcttctccacggtggccgccgtccagggcatcaaccagatcgtcacggggaaactcacggcgctgtcggagcaggagctcatcgaatggcgacacggacggatacaacggctgcaacggcggcctcatggactaccccttctcctacatcgcacacaaccggcgccccccacacggaggaggcctaccccgtacctcatggaggaaggcacctcccagcgcagcagcagcagcgagaagaagtggccgggatcgtcggaggacgccancgacgatgccgcggtggtcaccatctccggtacgaggacgtgccgaggaacaacgagcaggcgctgctcaaagcgctggcgcaacagcccgtcagngtncccatcgaggcctccggcaggaacttccagttctacagcggcggcgtcttngatgggccctgcggcacgcagctggaccancggggtagcggccgtcggctacgggacggcggccaagggccatgactacatcatcgtcaagaactcgtgggggcccagctggggcgagaaggggtacatccgcatgaggaggggcaccggcaagcgccagggcctctgcggcatcaacaagatggcctcctacccaaccaagaac

SEQ ID NO: 5913 - DNA, 603 bp, Zea mays
atggcggaggggaacggcggcagtcgcgccgaggctggcgtccgcgagtcctccgagccctcgccgaagcgctcctcgatccccgccatgccgcacgaagaatgcgtcgagggcatccgctccgcgctcaaacatcccacggtgcggttcctgagggagcggatggagagtgccgggtgcctggtgtggccgcgcctcatccgggcggcgacctgctcctccgccggcggctacgctagccagcaagggatacaagtttgctgcaatcacatgacctgtcaagatgagataactcaggtcatgattcatgaactgatacatgcttatgatgactgtgttgccaaaaatctgaactggacgaattgtgctcaccatgcttgctctgagattcgagccaatcaccttagtggtgattgccattacaaacgtgaattgttgcgtggtttcatgaagataaagggtcatgagcctgaatgtgtcaaaaggcgggctctgatgtctgtgaaaaacaacccatactgctcagagggtgctgcaaaagatgcaattgatgctgtatgggatatatgctacaatgacacacgcccatttgatagagcccca

SEQ ID NO: 5914 - DNA, 477 bp, Zea mays
atgaggacgcggatgccaaggattggttcaactgatgctattgatacatgggcaaaccagcacaaagataaaaagttgtacatagtattgataagcattcatggtcttatacgcggggagaatatggagctgggacgtgattcagatacaggtggtcaggtgaaatatgttgtagaacttgctagggctttaggttcaacaccaggagtatacagagtggatctactaacaaggcagatttctgcacctgatgttgattggagttatggggaacctactgagatgctcagtccaataagttcagaaaactttgggcttgagctgggcgaaagcagtggtgcctatattgtccggataccattcggaccaagagacaaatatatccctaaagagcatctatggcctcacatccaggaatttgttgatggcacttgtccatatcatgcagatgtccaaggtccttggagaacaaattgg

SEQ ID NO: 5915 - DNA, 546 bp, Zea mays
atggcccacgagaagaagctgtccaacccgatgcgggagatcaaggtgcagaagctcgtcctcaatatctccgtcggggagagcggcgaccgtctcacccgcgccgcaaaggtgctcgagcagctcagcggccagacccccgtcttctccaaggcgaggtacacggtgcggtcgttcggcatccggcgtaacgagaagatcgcctgctacgtcacggtgaggggcgagaaggccatgcagctgcttgagagcggcctcaaggtcaaggagtacgagctgctcaggaggaacttcagcgacaccgggtgctttggtttcggcatccaggagcacatcgaccttggtatcaagtacgatccttcaacaggcatctacggaatggacttctacgtcgtgctggagcgtgcgggctaccgtgtggcacgccgcaggaggtgcaagtcccgcgtcgggattcagcacagggtgaccaaggaggactccatgaagtggttccaggtcaagtacgaaggcgtcatcctcaacaaggctcaggccaacacgttg

SEQ ID NO: 5916 - DNA, 549 bp, Zea mays
atgttggcgcgccgacgggagcgcaggaggagctggcccgtggtcacctcagggcgtggaggaagaacccgttcgcccagatcagaagcaacaggtgcgtcgcctcccagtcccatgccgcgcccgccgcaggaggagggcggtgcaaggaacgcgagcacggccacaggcggtccttctccagcgtcatcgtccggtactcctcgtcgaacaagacgtccccagtccctgcgctgccgccgccgccgtcctcgagcgagtccgactgcgcggggccggcgctcaggaggagcagcagcgccagctccgaggtggagaaccccatccaggggttcatcgcctactgcaagaagtcccagcagcttgcctccgtcaggaagagcgccagcgacgccggcttccgcttcctgtcggccgcggcgtccaagatcgccgccgagtccgacggccttgatgacctcaccgagatttgcagaggatgataggaccatcaatcctgatcattgtacaatgatgcacatgcgttctggaggtttttttttgtttgtt

SEQ ID NO: 5917 - DNA, 357 bp, Zea mays
atggctagggtttttcgcgggtccctcctcctgatgtccccggcggcggcggcggcggcggcggcggcggcaggggccaagaaggcggcctccacgaagccgagggcgccggccgggatcacgaagccgatgccggtctccgaagcgttccgcaggttcgccggcggcgcgcgcgaggtcgcacgctccgaggccatcaagctcgtctggacccacatcaaggcccacggcctccagaacccgtccaacaaaaccgagatcaactgtgacgcgacgctcaagagcttgtttggtgggagggacaagatcgggatgatggaggtctcgaagctactgagccctcacttcctgaagaac

SEQ ID NO: 5918 - DNA, 933 bp, Zea mays
atgggctccggatctctgctcaaggtcttcgccaacaacttcgacgtccttgcagggcctttggtggcattggcttatcctttgtatgcttccattaaggcaatagagaccaaatctcctgtggatgatcaacaatggctcacatattgggtcctgtactcactaataacattgtttgaactcacatttgcatcaattattcagtggcttcctttctggccttcaatgaaattgatctttatttgctggcttgtcttgccatacttcaatggcgcagcctatgtgtaccagaattatgtgagacctgccttcataaagaaccagatggtcaacatttggtatgtccctcagaaaaaaggccttcttgggaaatctgatgacttcctcacagcacttgataagttcattgaagaaaatgggactgacgcgctgaagaaattgggaaacaaggctgccaacccatttaaacagtctggaaatcattttagggatcagaaagagccaaaatcttcaaaggatcccaaagaaccgaagccatcaaaagatgcaaagcaaccaaagccatcaaaagatacaaaggagccaaagccaccaaaggtttcaaagtcacccaaggactccaaagaacagaagaaggcaacgctgaaagatccgaagaaagcaccaaaggattctaaaggactgaagaaagcgcttaaggatccgaaagaacaggaatcattggaagacccaaaggaacatacagcaaagaaggccggcaagcgtgtgacgttcgccgaggtggagcctgagaaggagctcaaggcctcgaacagtgactggcacccatcctctgatttccacgcggcgtaccctgagcagaacccatgggctagcggcttcatgatctttgaggatgaaaacagctactggaaccgaggacccctagactgc

SEQ ID NO: 5919 - DNA, 531 bp, Zea mays
atgctacatttcatcaatatagcagttcgtatcttatcagcacctgctcttcatgtatcaggctgtaagggctcatgctcaaatatatggcagcggagttcctactggagcacacgacagtcccagagcaaggtttaccctctttttatacctaggaaaaatgtttgcacaggtggtgaagaaacttcattgacagaaagtggctcgagtaactttggggttgactctgtggattctgtcaagaaaccgtcttttgatcccaagagaagcaatagctttaacttttctggtgcatcttcccactccatggagaggcatcaatatttgcagagaggaatatcactattaaagacaagtgttacagccattactacctactattacaactcactgggcttggatgtgccatccaatctttctacttttgaggcgtttgctaagttgctccatatgttgtcgtcatcaaaaggcctttcgaaactgcctttgaattggacattgcttcaaggtcagaagaccaagcccagcagc

SEQ ID NO: 5920 - DNA, 318 bp, Zea mays
atgccggtgatcgagttccaccacgacgaggtgtgggagctgcccgccggcgccgaggtgctggcgcggtcggaccagacccgcgtcgagatgttccgcctgggggaccgcgccatgggcgtccagggccacccggagtacagcaaggacatcctcatgagcatcgccgaccgcctcctccggcataaccacatcctggactgccaggtggacgtggccaaggcgagcttcgacgtgcggcagccggacaaggagctgtggaagaaggtgtgcaggggcttcctcaaggggaggctgcagtcgcagcagcaattccac

SEQ ID NO: 5921 - DNA, 741 bp, Zea mays
atgtcgtcggcggtggaggccatctcctgccccaaggtcgacgtccccgccggcccggagccgggggagccggccaaggaagcggcgccgcccgcggagcactgcgacacggcgcccaacggcaagtgcgcgccgcgttgtcacggggaggaggaggaggaggaggaggacgaggaggacgaggagaaggcccccaaggccatcgacctcggtcccatggtcagcatcaaggagcagctcgagaaggacaaggacgacgagagcctgcggcgatggaaggagcagctcctcggcggcgtggacttgaactccgtgggagagacgctggagccggacgtgaagataatgagcctgtccatcctgtcgcccgggcggcccgacatcgtgctgccgctgccggtggagcccaacggcaagggcgtgtggttcaccctcaaggaaggctccccgtaccggctcaagttcaccttctccgtcagcaacaacatcgtctccggcctccgctacaccaacaccgtctggaagacggggctcaaagttgacagagccaaggagatgctcggcacgttcagcccccagctggagccctacacgtacgtgacgccggaggacaccaccccgtcgggaatgtttgcccgggggtcctactctgccaggaccaagttcctcgacgacgaccgcaagtgctacctggagatcaactacaccttcgacatccgccgggagtggccgtcgacgagc

SEQ ID NO: 5922 - DNA, 384 bp, Zea mays
atgcagtctaatcagcttgatggagccattccggcaacccttggtgagctaacacagctgagacggcttgatttgagcttcaacagcctgtttggttcaatcccatccaagattgctgaggttccattgcttgaggtctttgatgttcgcaacaacaccctttctgggagtgtccctgttggattgaggagactgaatgggggcttccagtatatgaataacaaagggctttgtggcgctgactacagtttgctaaagctttgcctttcttcacaggatgggctgaagcccagcaagcacagaccttttgaaccagacggggctgggaagacaagggggggggcctggtgggggaatgcccgacggtggtggagggctgagtgg

SEQ ID NO: 5923 - DNA, 123 bp, Zea mays
atgaggcggcgcagcgtgtggttgggcgtggcgtccatctcggcgggcgccagcgcgcggcgcgtgacggggcaggtggcgtggccgtcggtgaagagccagcgctcgatgctggcgcggtcg

SEQ ID NO: 5924 - DNA, 426 bp, Zea mays
atgatgcgccgcatcttgcgccagtggtcgccgtacaccgtgaacaccatgtcctgccccttgcccgtgaagatgtcgaacaccacgttgcgggtgcgggagccgaactccacgccctgcgtgtggagcacctccttggccagctccggggtcgacaccaccaccaggttgcgcacgcccatgcgcagcaggaagatgtcgccgaaccgcttcgccatggccatcaggttgcggtggttcaggtcgtcgcccacctgcagccagtttcccaccacgggggcgcccgggggccccggtgggaggcggtaccgcttgccggtcagcttggccacggcgatggccaccacagccgcggcgaacaggcccagcagggccttctctaggagggcgaggtccatgctgtgctgcctgccggtccggccgggg

SEQ ID NO: 5925 - DNA, 636 bp, Zea mays
atgaaagaagatgatctggaaagactgagccttcctttgatggttaccacaaaagaaaatgaggagaagctatgcactgctttcactgttacagtggatgcaaaagagggcacaactactggggtatctgccaaggacagggcaaaaacggtcatgactcttgcatctcctgactctaagcctgaggacctcaaccgccctggtcatattttccctttgaaatacagagaagggggtgttctgaaacgagctggacacaccgaggcatctgttgaccttgccatgttggctggattacctcctgttgctgtcctttgtgaaattgtggatgatgcagatggttctatggctcgcctaccaaagttgcgtgtctttgctgaaaaggagaacttaaagattatatctattgctgacttgattaggtataggaggaaaagagacaggctaattgaacgcgcttctgttgcacgcttgcctttgaaatggggcaatgtccatgcatattgctacaaatctgttattgatggcattgagcatattgccatggtgaaaggtgatattggtgacggccaagacattttggtgagggtgcactctgagtgcctcacaggcgacattttttggatccgcaagatg

SEQ ID NO: 5926 - DNA, 378 bp, Zea mays
atgatgggcttgcccgcgagcagctcggcaaggatgcagccggtgctccacaggtctacggcgacgccgtactcggttgcgccgagcaggagctccggcgggcggtaccagagcgtgacgacgcggctggtcatgggctgccgcttgccagggtcgaagaaggtggcgagcccgaagtcggcgatccggagcaggccgttgtcgtcgatgaggaggttggagcccttgatatcccggtgcaggacgctccgcgcgtggcagtggctcaggccctcgaggatctggcgcatgaggcacttgacctgcggctccgtgaagcgctggccggacagcgcggcgaggccggcgaggtcgtgctccatgtactcgaagacgagg

SEQ ID NO: 5927 - DNA, 933 bp, Oryza sativa
  misc_feature (816)..(816): y = cytosine or thymine
  misc_feature (819)..(819): s = guanine or cytosine
atggggcgcggcaagatcgagatcaagaggatcgagaacgcgacgaacaggcaggtgacattctcgaagaggcggggagggctactgaagaaggcgaacgagctcgccgtgctctgcgacgcccgcgtcggcgtcgtcatcttctccagcaccggcaagatgttcgagtactgcagccctacctgcagtttgagggaactcatcgagcattaccagaccgtcaccaacactcatttcgaggagatcaaccacgatcagcaaatatttgtggagatgactcggatgaggaacgagatggagaagctggacggtggcatcaggaggttcaccggcgacgacctctccaacctcacgctcgccgacatcaacgatctcgagcagcagctcgaattctccgtcaccaaagtccgtgcgagaaagcatcagctcctgaaccagcagctggacaaccttcgtcgcaaggagcacatcctggaagaccagaacagcttcctgtgccgcatgatcaacgagaaccatcatcaggcggcggtgggcggcggcgacgtgaaggcgatggtggatgatggcgccggtgctgtcgatgctgacggcggcgccggcgtactacggcgaggagtcgtcgagcaccgcgctgcagctcaccccgccgctgcacgccgtcgacgccgccgccgccgccgggttccggctgctatgccgacgcagcccaacctgcaggaccccggctgcagtcagcagcagcttccatgccgccgccgccggccacggcctgcagctgtggtaagaacacaaagacgcaagcaaagcatacayggsctacatcctgatactctcatcagagatctagatgattgcttgctaattaagcacatgatggcattgtcgattctgggagctaggagtaacttggagacgcatgaagatgcatga

SEQ ID NO: 5928 - DNA, 1191 bp, Oryza sativa
  misc_feature (220)..(220): n = any nucleotide
  misc_feature (224)..(224): n = any nucleotide
  misc_feature (547)..(547): n = any nucleotide
atggccgcacttgataccttcctctttacctcggagtctgtgaacgagggccaccctgacaagctctgcgaccaagtctcagatgctgtgcttgatgcctgcctcgccgaggaccctgacagcaaggtcgcttgtgagacctgcaccaagacaaacatggtcatggtctttggtgagatcaccaccaaggctaacgttgactatgagaagattgtcaggnaganatgccgtaacatcggttttgtgtcagctgatgtcggtctcgatgctgaccactgcaaggtgcttgtgaacatcgagcagcagtcccctgacattgcacagggtgtgcacggccacttcaccaagcgccctgaggagattggtgctggtgaccagggacacatgtttggatatgcaactgatgagacccctgagttgatgcccctcagccatgtccttgctaccaagcttggcgctcgtcttacggaggttcgcaagaatgggacctgcgcatggctcaggcctgacgggaagacccaagtgactgttgagtaccgcaatgagngcggtgccagggtccctgtccgtgtccacaccgtcctcatctctacccagcatgatgagacagtcaccaacgatgagattgctgctgacctgaaggagcatgtcatcaagcctgtcattcccgagcagtaccttgatgagaagacaatcttccatcttaacccatctggtcgcttcgtcattggcggacctcatggtgatgctggtctcactggccggaagatcatcattgacacttatggtggctggggagctcacggtggtggtgccttctctggcaaggacccaaccaaggttgaccgcagtggagcatacgtcgcaaggcaagctgccaagagcattgttgctagtggccttgctcgccgctgcattgtccaagtatcatacgccatcggtgtcccagagccactgtccgtattcgtcgacacatacggcactggcaggatccctgacaaggagatcctcaagattgtgaaggagaacttcgacttcaggcctggcatgatcatcatcaaccttgacctcaagaaaggcggcaacggacgctacctcaagacggcggcttacggtcacttcggaagggacgacccagacttcacctgggaggtggtgaagcccctcaagtgggagaagccttctgcctaa

SEQ ID NO: 5929 - DNA, 1680 bp, Oryza sativa
atgccggaagccaagctcagccagcaaatcgagcttgtcgaatcgaaggaaggaggggaggaagcaagcaaggcatcgaccgaccggaaacgaacctgcgcgcggttgtcggagctggcgagcgcggaggccatgcgcgtggccatccgccgcgtccgcgcgctggccgcctgctcatgtgaaggaattgggctggtctgctggttcggctcggcccatcaaccagtccaagtttcgatctccataaatctcgcatcgcaactacggctacctgcgctgcgcacaacacaagatcgtgacttcgtgagtcgtgaccgtcgtctccacacctatggacaacgcggcggcgccgccgtcatctggagcggcggggaaggagatggccacggcgggggcgctaccggacgacctgctcgacgagatcctcctccgcatgccggcgcgttccatcctccggtgccgcgccgtctgcaaggcttggcgctcgcgcacctcccatccctacttcctccgagcccacgccgcccgttccggataatcgccgccgccgtggttgacacaactgcaattcccgacggcgaattccgcaccaccatcagcatcagacctctcggcgacggcgacggcgaccgctcgggggcggccgtgtcgtcgtcgtcgtcgttcgcctcggtgcggttcggatcacggccttttgtcctcggctcctgggatggcgtcgtgtgcctggtgcccgccggtgtcgttcgccctctcagccgcatcgaccgatacgtgctcgtcaatccgctcaccaaggcctgcaccagcgtgccaccgccggcaacccgcggcatcgtcatctgcggttacgcccacccgaccacgtcgcgctaccacctcctccacgccgacgacgcctatccctacaaccatatggcggcggcgaccatccggattctgcgagtcggggagaagaacaacgtgtggcgcaagatcgcccgccaccctgcgcctgcgtgcgtggagtcgaggacctacattcgattcggcggcgctccacccgtcagcctccacggctgcctgcattggctggtcgccccgttgtcggcggcgtcggcacggcctctcctatcggtgttcgacatggaacgggaggagttccggcagatggacgcccccgaacaatgggctcgccatgggaacctgccgcacatgatgggtgtacagatcgctcggctctccggcaagctgtgcgcgttcgtcaacgagccgagcgccagcgcgttggggatgtggacgctcgaggactactccgacccgagcagctggcggatggagcggagtatcgactactcgcgccacggcgccggcagccggaacatcgcgcgcacgttccgcaaccggttctcggcggccaccaccgcggtggaggtgctacccgatggcgtcagcggcaacggcgatgtcggtggcggtggcgaggaggagatcatgttcctgttcaaccagttcgacacgagggaggctgtgtacaacgttgggcgcgcggcgtggcggtggcgaaggattttgccaccgccgacgaggcgcgtgatggcgcacaaggagtgcatgttgccgcgtgaggtgagcttcggtggggcggcgcattttgtggaggagagtgacatcggcggccaccgttgcatttgcatatga

SEQ ID NO: 5930 - DNA, 1107 bp, Oryza sativa
  misc_feature (1062)..(1062): n = any nucleotide
atggccaccgcgaagccagcctctccctcgccgccgccgagcaccgccgtcgtcccggccgccaataccgcagcagccgcggacaagccggcggtcgagcagctcctggaggtggcggaggacgaggtcgtcatcgacttcaagcccaacgccaagtgccgcgctgacctccgcctccgctcgctgcacccgtccctccccgtcgccttcaaggtccagacctcctcccctctcaagttcctcgtcagccccccgcgcggcgccgtgcagccgctctcgtcggcctccctccgcgtcgtgctccgcccgcagcagcacgctcccgccgccgctaccggcggcaccaccgccatccgcctccgcgtgttcttcggcgggccgtacctgctccgcctcgcggcggaagccggggacgccgcggccgtgcgcctcatcctgcgccggcagccgcacctcctgccgctcctggagcccgaggcggcggtgcccgacggcgccgagcagtgggcgccactgcacgcggtggccgcgaggggggacaccggggaggcggcggcggcgctggtggacatgggcgccgacgccgcggcgaccgacgcgcgcgggaggactccactggacgtcgcgcgcgagaagggctatcaagaagtggtggacgtcctggaacggtgggaactggtcatgacggcggcgaggcgaggcgacctccagagcctcgagtccctcctcagcaagcgcgccggcgtccggggacgtgaccagtacggcctgacggcgctccaccttgctgccatcaaagggcactgcgacgtgatcgcgctgctcgccgggtcaggctgcatggacatcgagtgcgaggacgtggaagggcaccgcccgctgcacctcgccgtcgaaggcggcagcgccgaggccgtcgagctgctgctcgacatgggcgccgaagtgcacgccgccaccaggcggggcgcgacgccgctccagatggccgtgacgatggggtacgaggccatcgcgctgctgctgcgaggccgtggcgccgacgaggcggccgcgccggcnttgtgcatcgcgtcctcgtcttcctcctcgatatcgtgtgcgtag

SEQ ID NO: 5931 - DNA, 1359 bp, Oryza sativa
  misc_feature (709)..(709): w = adenine or thymine
  misc_feature (743)..(743): m = adenine or cytosine
  misc_feature (760)..(760): s = guanine or cytosine
  misc_feature (822)..(822): r = adenine or guanine
  misc_feature (858)..(858): r = adenine or guanine
  misc_feature (882)..(882): y = cytosine or thymine
atggcgctcggtgttgacaatttaggtgttcaggatttgacttggatcgttgacaatgttcggttatgtctagcatctctgattttcttcatgctggcttgcgagctcgttgatatcaatgatttctgtggaaacaagaatgcattcaaggcactcattgctgccgagtactctggtgtcaaggttgagttggtgaagaactttcagatgggtgtctccaacaagacacctgagtttctcaagatgaatcctattgggaagattcctgttctagagactcctgatggtcctgtttttgagagcaatgcgattgcacgatatgttacccgctcgaaggctgacaacccactctatgggtcttcactgattgaatatgcccacatcgagcagtggaatgacttttcggccacagaggttgatgctaatattggaaaatggctctacccacggctaggaattgctccctatgttgctgtgagtgaggaagcagctattgctgctttgaagagatcattgggtgccctcaacacacaccttgcatcaaacacataccttgttggccattcggtgactcttgctgatattgtgatgacctgtaacctctacatgggctttgctcggatcatgaccaagagttttacttctgagttccctcatgttgagaggtacttctggaccatggttaatcagccaaactttaagaaagtcwtgggtgatgtgaagcaggcagagtctgtcccacmagttcaaaagaaggctscaccaccaaaggagcagaagccaaaggaagccaagaaagaggccccaaaagaagctccaaarcctaaggcagttgagaaaccagaggaggaagaggargcaccaaagccaaagccaaagaaycctcttgatttgctccctccaagcaagatgatccttgatgagtggaagaggttatactcaaacacaaaaacaaatttccgtgaggttgctatcaagggtttctgggatatgtatgacccagaaggttactccctgtggttttgtgactacaaatacaatgacgagaacactgtgtccttcgtgaccatgaacaaggttggtgggttcctgcagcgaatggacctgtgccgcaaatatgctttcgggaagatgcttgtgatcggctctgagccgccattcaaggtgaagggtctttggctcttccgtggccccgagatccccaagttcgtcatggatgaagtctatgacatggagctctatgagtggaccaaggttgacatctcagatgaggcccagaaggagcgcgtcagcgccatgattgaggacctggagccatttgagggcgagtcgttgctggatgcgaaatgcttcaagtga

SEQ ID NO: 5932 - DNA, 2034 bp, Oryza sativa
  misc_feature (1366)..(1366): n = any nucleotide
atggaggacgtcgtcaccgacgcgccgccgccgtcccgcttctccccggacgacctcgacaacttcgccgctccaccgccgcagcccacccctatcctcgagcctcgtgtccgccctcagcccgaggaggtgctggtgctcgacgcggtccggagccggggcctacaggggcaagctcgccgcggacgagcccgtggaggggaagctggagaccagggcggcgcgggggccgggaagcgtcggcgcggcccgcggcgtggcggcgctggccccgcccgggagcgtgccgacgaggcgacgatggacgccctcacccgcctccaccgcgccctcgccggcggcgacgacgacgaggagcagccggaggattctatccttggcgacaccgagggcatatgctccctatcccctgtccagcgggtctacggcttcgccgcgtgcttggttgcgggactggctctgatgatcctgattcttgtaagtaaaccacttaatcttgtgtttgccctgtgctttaattgtgcagatccattccaaggttctaacattgattgcaatcatatgcgagatctgtgctctgttctgaaaagagtgtttgctgcttgggcgtcaaagctgccagaacacagatcacccaaatatgcgactactgttgaagtcttcgagttacaacacctggctctactcgccagccactgtctggtggggtccgaccaggcccacttgtcacacacgtcgcccccatcgctgcatgggcaaagcgatctcccttctccggccaccgcgagagccacagccacgagagagcgagggcgagggcgagagggggaggatgatggagctgaggaagcgcccgaggccgcggcgcgtcgaccccgacttcgtctcgtcaccgccggcttcgctgctgctgccgccgccgaggaagcgggcgaggaggcaggccgcgccgccggcggctccggctccggctcctgctcctgcgcgcccatcaccagcggcgaaggaggcggccgacagccccgtcgctgggcttcagccatccgtgtgctgcccgtgcgaggcgccgctccgggcgtgcaggcttccgcgcgcctccttcctcgctcgccgtcgccctcccttcgactgtgtggtttcgatgtgcgcgtgtgtttctggaagttccgtggattggaggaagggaattggtacgaggcggacatgtggacggaggtggccaagtacctgttcggcgcggagctggtgcgcctctcctccacctgccgctggttccgccgcctcctcgccgacgagttcatctggcgccacgccttcctccgcgacctctccctcctccccgccgccgccgaccggtaccctcccngcccgctccaccgctcctggcgcctcctctacgccgccgccttcaacggcgcccactcgtactggttccgccggagcagcaggcacattggggcgtaccggattggtgggttcctgctcgagtcgccttacatgctcctgacggcgaagctggcggtgccgcagtggctgccgccgcaggaggacggcccgcagatcgccatcgagatgaccggcgcgtgcgtgctccccaacgcgcgccctggcatctggatcaccgacttccatcttgtgaggtgtcccaattgcaccctcaacaagtgcgcaggggtcctgcaggttctggacgcgcgacactgcgagctgttcctggagcagggattctggaatggcacctgggagtacgaggacctgggcgaccactacaacgacgaggagacccccaccgcagcctgcgccatcttcaacgccagcacccgcgctcatgagtccatttcatgttcgtccctggatcatttggcatttgtcaattccagttctctgttcatttacattcttggtgttctccactcgaagtcttgggtcaggagatgcgacgacccacagcccaaggcacattgccgcccatacgctgttgccctcaattccaacctcctgtccaactccaaccagggttataagacgttttga

SEQ ID NO: 5933 - DNA, 3915 bp, Oryza sativa
  misc_feature (3888)..(3888): n = any nucleotide
atgtcgcacagctccggcgcttccgacgcctcgtccacctctgacgaagagcctgtgccggcgccttccacctctgttcttcaaaccgtcaacatccgctcccacgtcccggtcgtcctcgatctcgacgtctccaactacagccagtggcgctgcagcttcgaatcggtcctcggcaagttcggccttgaggcccatgttcaggagccgcccgctctcgacctccgcactgccgagtggcgccgtgcggatcactgcgtggtcaattggctgcacaactccatcgccaagaacgtcttcgacgtcgtctacaagccccgcgcctctgccttcaccgtgtggagcgacatcgaaggcgtcttccgtgacaacgccgtccaacggtctgtctaccttgagaccgagttccgctcgatcaatcaaggtgacatgaccatcacgcagtacaccgccaagctgaagcaactcgccgacggcctccgcgacatcaacatgcccgtgtctgagcccagccaggtgctcaacctcctgcgcggcctcaacaccaagttccgctccctccgcgccagcatcgccgaccggaatccgccacacactttcatgaccgcgcgctcctacctgctgctggcggagctccagatgcagcacgacgccaaggctgaagccggggaggccctctacgccggcaccgggtcttcctccggcacctccgacaccaccggccagcctcgtcccaagggacggggcaagcgtcgtggccggggcggcggcgccccacctggcggcgctccttcgactcctggcggcggcgctggtgccgggcacgacggccagcctcgccctcctgcgccttggggctacaacccctggacaggctttgtccaggcctggcctttcccgttccgggctcccggcgcgggtgtgttgggccctcgcccgccgttccaggcccaacaggccatgaccgcgcagcacctgcttccggctcttcctccggcatctccaggagttcaatccaccggcgcctgggacaacagtgcgctctacagcgccttgcagtccgccggcgtcgccaccaccactcctccgagcgctgcggattggttcctcgacaccggtgcgtcagcacatatgtcctccacccctggtattcttgctcatccccgtcctcttcctttctcctcttgtatcactgtcggcaatggtgccaagctgcctgtcacgcatacagcttccacccacattcccacatcctccactgatctacaccttcataacgtgcttgtttctcctcccttgattaagaatttgatctctgtgaaaaagctaactcgtgataataatgtctccattgaatttgatccaactggtttctccatcaaggatcttcaaactcaggtggtgaagctccgctgtgacagcccgggtgacctgtaccccctgcgtctgccatcgccacacgccctctctgcgacttcctcgccgtcggtggagcattggcatctgcggctcgggcaccctggctctgcttccctgtccaagaatggcaaggcggaacgtatcctccggacgatcaatgactgcgtgcgcacaatgcttgttcacagcgctgctcctttgtctttttgggctgaagccttgcagacggcgacgcatctgatcaaccgacggccatgccgcgccacgggctccctcacgccgtaccagctgctgctcggcgctcccccgacgtacgatcatcttcgcgtgttcggctgcctctgctaccccaacaccatcgcgacagcgccgcacaagctcagcccgcgatccctggcgtgcgtcttcatcggctacccggctgaccatcgtggctatcgctgctacgacatggtctcccgccgggtgttcacgtcgcgccacgtcacgttcgtcgaggacgtgttccccttccgcgacgcgccatcgcctcgcccgtcagctcctccgccaccggaccacggcgatgacactattgtgctgctgcctgctccagcacagcacgtcgtcacacctgtcggcaccgccccagctcacgacgccgcatcgcctccgtcgcccgcgtcgtccacgcccagcagtgctgctccggcccacgacgtcgcgccgcctccatcacccgagacgtcgtcgccagcgtccgcctctccacctcgacacgccatgacgacgcgtgcgcgggctgggatcagcaaacccaacccgcggtacgccatgactgccacgtcgaccctgtcgccgacaccttcgtctgttcgcgcggcgctccgggatcccaactggcgcgcggcgatgcaggctgagttcgacgccctgctcgcgaacaggacgtggactctggttccccggcctcccggtgctcggatcatcaccggcaagtgggtcttcaagaccaagcttcatgctgacggctcactcgacaagtacaaggcacgttgggtggttcgcgggtttaaccagcgcccgggcgtcgactttggcgagacattctcgcccgtcgtcaaaccagcgaccattcgcaccgtgctgacgctgatttcctccaagcaatggccggcgcatcaactggacgtttcaaacgcgttcctgcacggccatcttcaggaacgtgtcctgtgccagcagcccacaggctttgaggatgctgctcgcccggcggacgtgtgcctcctctcccgttcgctgtacggtcttcgtcaagccccgcgcgcttggttcaagcgcttcgccgatcatgcaaccagcctcggcttcgtccagtcccgcgccgacccctccctgttcgtgctgcgccgtggctccgacacggcctacctcctcctctacgtcgacgacatgatcctctccgcgtcctcgtcgagcttgctgcagcgcatcatcgatcgccttcaagcggagttcaaggtcaaggacatggggcccctgaagtacttcctcggcatcgaagttcagcgcactgccgacgggttcgtcctcagccagtccaagtacgccaccgatgtcctcgaacgtgcaggcatggcgaactgcaaggccgtggccactccggcggacgctaaacccaagctgtcaagcgacgaggggcctctcttccaggactcctcctggtaccgcagcattgccggcgctctccagtacctgaccttgacgcggcccgacatcgcctacgccgtccagcaggtgtgcttgcacatgcatgctccgcgcgaagctcacgtcaccctgctgaagcggatcctgcgctacatcaagggaacggccgcgtttggcttacaccttcgcgcctcgacgtcgccgacgctcaccgccttcagcgacgcagattgggccggctgccccgacacccggcgttccacgtccggcttttgcatcttcctcggcgactccctcatctcctggtcgtccaagcggcagacgaccgtctcgaggtcaagtgcggaagccgagtacagaggtgtggcgaacgcggtggcggagtgcacttggttgcgccagctgctcggtgaactccactgccgcgttccacaggcgacgatcgcttactgtgacaacatctccagcgtctacatgtccaagaatccggtgcaccacaagcggaccaaacacatcgagctcgacatccacttcgtcagggagaaggtcgcgctcggtgaactccgcgtcctaccgataccgagtgcccatcagttcgcggatgtgttcacaaaagggcttccttcaagcatgttcaacgagttccgagccagtctctgcgtcggtgatacgacggctgcgactgcgggggggtgttggcgaacggcttcgtcagactctcgcggcgcgctccacgcgcacgacgcgcaccccgcgcacgacgccgcgctcctcgcnccgctcgcaccgctgcacgtcccttag

SEQ ID NO: 5934 - DNA, 1119 bp, Oryza sativa
  misc_feature (6)..(6): n = any nucleotide
  misc_feature (30)..(30): n = any nucleotide
  misc_feature (38)..(38): n = any nucleotide
  misc_feature (986)..(986): n = any nucleotide
  misc_feature (1049)..(1049): n = any nucleotide
atgggnttgagcccgggggcaaaccgagcntcgcggcntcgagctccaccctgcgtgcgacggcgccgagagagggaaagagagcttcaaccgagcatcgtggcgtcgagctccctgacagaggccggcggggagaagtgggagaggaggagagttgtcgatgaggaagtgaagccgatctcgccgccgccgaggaaggaagaggaggaggaggagccgatctcgccgccgcaaccactgaagcgggagatctggcaggagaaggcgagtgcgttctcgtcggtggtggtggtgctcggcgacgacaacggcgccaacgcccctcccttgctcctgcgtcgtcgccgccttgttcccccgccgccgccttgctctccttcccacctgttggctggcgacgctggcctgcccagaaccccagagagaagaggtgccatagaggaaggaggcggtggagacaccggcggtggcaagggcgacatcggcgaagagttcgcctccctcctcctcccatcctatcccacggaaggtgtgaaactctattcgcacatgtgtggcaaattttggggtggtggttttgcagtatttgcagcagttcatgcagctctgactctgcttgtcacaagctcagtaattgaagcagctatttcccagtgtgcacgcgttgtcaatgtggacttcattgttaattacacaatcccatatgatattccttctgctgcgttggtggaactagatgatgaaatacaagctaaggctgctatcgacttgatgaataatttccctttcataatcggtggaaagccaaggcctgtaagagctatctatgcaaagcatgaaatgtttctggatcggcctcctcgccctggaatcaagaaagagttccagtgggtgaaacaagaagatggaatagagtatgaaggaatgaacaaactgcggctccttgcaagaaggcaggaaacagaaaatatggcactcataaagantctattggaagaggacaaggacctagcaaagcagcaacaggagttacttgatggaatttacangaagagtaacttcttgcgctgcgcggagatgattcgctgctgtcggatgctgtctattatgcatgtctga

SEQ ID NO: 5935 - DNA, 1080 bp, Oryza sativa
atggccggggacggcaaggtcgaggtacacgacggctggtccgcaccgccggtcgccaccatcgcctcatcccagatggtgttcaccacaattgaatcgacggagcacgcggcgtctgccgaggcggggagagctggagcgacggcaacagtgggcgcggaccagagctgtagcgcgccgccgcctttcgaggctatcgccgggggtggagaagggaaaggggagaggcggcaccgccgagatctcgcccgccctctatcgccgagctcggatgcgtcctccacaccgtcgagctactcctctatctccgccaccgcctgccgaagcgtcgccgccgtccgagaagggagaggggagaggcagcgcagcgaaagggattcgctttggctacgtacattggtgtacgatggcgtcgtctcgctccgtcgtgctccgggtgctggtcgcggtggccgtcgtggcagcagccggggcgccgcgcctcgccgtcgcggactcgccgccgcttcaggacatctgcgtggccgacctgcgggcggcgacagcggtcgacgggttcccgtgcaagccgacggcgtccgtggtgagcgacgacttcttctgcgacgccatcgtccaggcgcccagcacgagcaacccgttcggcgtcaactcacgcgcgccacggtgtccgcgttccccggcctgaacacgctgggcctctccatcacgcgcaccgacctcgcgcccggcggcctcaacccgccgcactcgcacccgcgcgcctcggagctcgtgctcgtgctcagcggcgaggtcatggtggggttcaccacggcggccaaccggctcttctccaaggtggtcagggagaaggagctcttcgtcgtgccccgcggcctgcagcacttccagctcaacgtcggcgccggcaacgcgtcgttcgtcgccatgttcgacagccagtcgcccggcctcgtcacgccgaccttcgcgctcttcgcgacccagccggccatgccgatggaggtgctcgccaagacgtttctcatgggcgaggatgaagtgggcgccatcaaatctaagtttgccggcttctga

SEQ ID NO: 5936 - DNA, 942 bp, Oryza sativa
atgggagctggtggctgtgtgcaggacgaagctgaagcagacggagatggagtgcgagtacctgaagcgctgcttcgggtcgctgacggaggagaaccgccggctgcagcgggaggtggaggagctgcgggcgatgcgggtggccccgcccacggtgctctcgccgcacaccaggcagccgctcccggcgtccgcgctcaccatgtgcccccgctgcgagcgcatcaccgccgccaccggcccgcctgccgagacgacgcagcggtagagggccccgtgttggcgttgttgcgttgggtccagtcgtctcagaggagtcagaggcgtggacaaaatgtttgttgcattgtttgtgttccattggtcgttgatcttagcttgatgatctgtgattcgcgccttgctcgtctagcacggtggccaacggtgcgtagttcgtcgtcgttttctttcctcgggagaacaactgccaattctgttggcaaatccgcaaagcgtgatccaagcgagaccatcgttcatgcatgcatggtccatggctccatacaattatcgatcctctgtccacacaacaccttcaccgcgaacccgtgggcctctttgcaatggaccaaggtttggttggtcacaaggtactggcctatatatgtggaccttagtaagggctcaggctattcgtccgtgtattacgctgtcttgggccaagggattaacgatctgtgcctaacaaatgtcttgatgtatgagcggaacacacaagacgacgtagttacgtattatgaccggagacccaccatttctgtccttctcatacgtacctggagaatccatctggtcaagaatatggccccgaatatggtgccgcctgatggcgacgaaccacaagatgtgggctcctcctctagcttcgacggtacgagatttggtggtggcccgacctag

SEQ ID NO: 5937 - DNA, 1491 bp, Oryza sativa
atggagccatggagagcactgcatctgggtcaatcaacaattatgaacgtttctcccttccattcgctctgccctcatctgaagaggaccacagcacctaacgaccgagatgatgaactgtggactggagagcaccacacacccctcccggatttcctggcgaggaggagccagatcccggcacagtgctgggcaggcagtgccccccccacaccatatgcccggctcctgggcgatgatgcagcaactaccggggtcgccatcgcccaaccgaacgtctcgcccggtgccctcccgcccccggccgagatatgcagccaccaaccgtacggtgtgcgccccggaaaagtgaccacatcttgccatgatgggcatgagcttgggaaggaaattccttttgtcagtgtaatccagtgcataatacaccagcactgtccaccatatgcagatggtttcaactcgggttggggccacatgtacattattgttggtagtgctgtactgttcagtgtacatgaccatcctcgcaagtactctgcaatttgccaagatctgaagatctggagttctggacctcatgttcggtacactgctagatccaaccccaacatgaaagagattttcactgcacaagaccataaaccgactgacacgtgggccccaccacaccctggtcccactactcccacacctcgcccgcgccgacttctcgcctctctgacttaccgcatactttactccaccaccaccacccctccccctttgccaccgcgcccacccttcaaagccacccccaaccctcaccgacaggtggggcccaactcctcgtgggtcccgcccgccattgtcaccgtagcggctcacgcagaggcgacgacgacgcgcacgcgcaccgccctcctccctccccgcgatctcgccgtaggggatctcgtcggcggcgaggaagcaaaggccgagggggcagcggctggggaggggaggggaggggagagcggcattgggatcggatcgaagcttctggaaggttccgggcgcggatccggctcggtgggttgctcgctcgtggctggaggtagcggcgcgctggtggtatcggcttttggtctaatgctttgcttcggtttggagtttggagcggggggagcaactctgaggtttggttttcctgagatggaggacctgctgggcgcggaggtcggcaagaacgactatgactggcttgatcttggagtgacatgtttttgtttgtttcgtaaaagaggatatgctgcattgcccccagaaacgtcactcttccggcttcttactccccctgggacaccccgttgtcctgtactggaggttgctgagaaaacaccatccccaaatatattacctaagcgcactgccactagatcatcgtcaaccaccagagcgtcgaggaccacccaaaccagggagtctggtgataacacgtttcttgcttctctacctactcgaactacctag

SEQ ID NO: 5938 - DNA, 261 bp, Oryza sativa
  misc_feature (12)..(12): s = guanine or cytosine
  misc_feature (15)..(15): s = guanine or cytosine
atggcgacgtcsgcsgggttcctggcgcggcgggcggcgcaaaaggagagggtgcggctgctctaccgccgcgccctcaaggacaccctcaactgggccgtccaccgccacctcttctaccaggacgcgtcggatctcagggagaagttcgaggcgaacagagatgtggacaacccggatgtgatcgataggcttatcgatgatgcggaagcgcagtacaggaatttccagcatcccgatccctacattggtaagctctga

SEQ ID NO: 5939 - DNA, 180 bp, Oryza sativa
atgacaggtttggttgagtccaagcagagccaatctgcaagccaagggcgcaggagcgtccacgtgaggtcaagacaaaagatgatgttaaattgtatcgccatatgcttggagaaggttgagagggagaggatgacggcgaggccacaaacgaacagatgggaggaaggtgatagctag

SEQ ID NO: 5940 - DNA, 663 bp, Oryza sativa
atgacgcgccacgccggcgcccgccgccggggcggcccgggcttcgtcagcctcatcgtcgtcgtcgtcgcgtccctgcccgaggagtgcgccgcctacgtgcgggagtatctcaccggcgtggcctaccgctccgacctcgaggtcgtcgcgcgggaggcctccgcgtacgcgcggaccgcccgcgtcggggacgacggccgcgacgcgtgggtgttcgacgtcgacgagacgctcctctccaacctcccctactacgccgaccacggatacgggctcgaattgttcgaccaccgggaattcgacaagtgggtggagaggggggaggcgccggcgatcccctccagcttgaagctgtacaatgaggttcgcgaccttggattcaagaccttcttgctcacgggccgcagcgaggggcaccacggcgtcaccgtcgacaatctcaagaagcagggcttccatgattgggacaagctcatactaagggcgccagctgatcgcaagaagacggcgacgatatacaaatcggagaagaggaaggaaatggaagaggaggggtacaggatcctaggcaactccggcgatcaatggagcgacctgctgggtttctccacgagcgctcgctccttcaagcttcccaatccaatgtactatattccatga

SEQ ID NO: 5941 - DNA, 2778 bp, Oryza sativa
atgggttccagaggcagacgccaatcactatcgcctactccatctagaagagcaagttcatctcatagtattgaacgagatcgtttaagctcgtatagcaaagcttctgcaacatcttctggtgaagatgatctggattccatgcagtctctaccagttgcctattccaccagcccagctgtaaaaaagagcttgtctatgatgaagaccagaactattgcttcatcaaagaagccgtccacaactttttccactagttctgtcccaaagcggtcatttgattctgcagtttggttgatggatcatcgcaaagctcccaataatatgttccggccactgctatcaagtgtccctactacgacatttaatgctggcaaaggaaatgttgtgcagcggcctatgttttctcataattcttatatgacaactagcagcaatgcaagctctgagcatagtgccagtttcggcccatatgtggataacgaccaagagcagcatgatcagattagtgaatgggatgataaccatcaagttcatggtgatatatttatgtttgataaattggatgaattgaatgaagaaaccagtcatgaggagactacaaaatttgtggaaagtgatagacaggacattgacatggaaaagggttgggcagctagtcagacttctggtacaaacagttctcatgttggatatggtgaaatggctacttgcaccaggtgcgggaacgttttcaaggttatggatgtggatagacaaggtgactattgtgaagaatgtggtttattgcttagcatatgttctgcaggccctgtgacacaaactttacaagaagcacaccaacaggacgaaataactgcaaattgtaaatcatatgctgaatctggaacttctatagcctcggattgtgtagagtatagggaagaagcatctcttggtcatcaatttaatgatgaacctccagctgattgtataaaagcatgttccccacttcagtcaatggtggacacaaatgaggaaatgctgctggctcatgaggtaagtgataaccaacaagcatctgcagaacacgagcatttcagggaccaaattaacagccacagtgaaagcttgccacaatgccttcctgagctaaaccgccagcataatgattccatctctcaaactgcctctggtgataattatcaactgggatcaacagcatattcaagtcctaaggtagaaaacactgatgccactgggatatcggtactcttactccagaagtcaagtagcaataaatggcctgttgtggaaggaaggactctgtctgcaacaaatattctttgttcagaaccctattatacaagggatagtatcagtgctatgaggcgtagctttggacgggatagctcttcagcaacttcttccattgatctagggtcatcaaggcaatcagatgtacgttttgagcgtctcaggagtggcaagaggggtgatttcgagaaggctcgaatgagcagtaccatgagccatcaaagtgttgcttcagtgtcagatatgtcaattagtggttcatcagcttcactttgccctcagagtgatgttattggtgacacttgtttcccaattgacacgctggaaaggagtgcatcgagaacaacagtctctattgaagaacatgacagctcttgtatggatgctttatcaagtggtatggagtgttcatctgctgtgcagccgataatcaatgatgaaatccttgttgacttgaacacctcaggttttcataggttaagtgaaacagaagatatacttattaagaaccataatatggaaatggtggctgacaatgatcatttgagcactaacttgtgtttatcagatattgaaatgccaagtgatgccctagaatcttcagctgctgaggaaagttatataccaaaaactgaggaagatacttccaccaaagcacactgctatacaatcagcaccctagagcatccaagcgatgagaacaactttgatgatcttcaaatgcagtctgaagcagttcagtcttcaaatgaggaaaataaatccaatggctgttgcacgcttgctgtctctgaggatgacgtgttggtttctggaacagatactaacataaaggaacttcctaatgatgatgtttccatgcttggtgtagtgactagtgccttcaataacatattaaaaccacctgaagatagtacagatgcacctgctactgcagcttgtaaactcagcataccatcaccagattacagctgttgcacctcatttccatgtctgacaaaatcacccgaggcagttgaaggatcgaggaaagaaattcagagatgcttcactttggaagaagctaccgatacaattctcctctgcagttctattgttcatgaccttgcatacaaggcagcgacaattgcactggaccatgagcaggaacgagtacacgcagagcctactcgcccatctgttaccatcgttggaaagtctattccaaaggaggatggtttacttaagctgactcacagacgaacgcctaaccgtaaggttaaaaggaaaagattggaaggtgaaacaaccataaccgaaaatgctgaaaagaaagatgatatctctacagaccactcacccgtgcgttcctcttctggaattacaaggacatctgagagcatgaagcctccaaaactggaatccaaaccaggatctataggtgttcttgcatgcatctgtcatcatcagcactgcttcaatcacttgtatgacaacctatag

SEQ ID NO: 5942 - DNA, 1364 bp, Oryza sativa
atggcgcaggcggtggtgccggcgatgcagtgccaggtcggggccgtgcgggcgaggccggcggcggctgcggcggcggcgggggggagggtgtggggagtcaggaggaccgggcgcggcacgtcggggttcagggtgatggccgtgagcacggagaccaccggggtggtgacgcggatggagcagctgctcaacatggacaccacccctttcaccgacaagatcatcgccgagtacatctggtggttggaggaactggaattgacctcagaagcaaatcaagggtcaatatcaaaaccagtggaggacccctcggagctaccaaaatggaactacgatggatcaagcacagggcaagctccaggagaagatagtgaagtcatcttatagccacaggctatattcaaggacccatttcgaggtggcaacaacatattggtacgttatgtgtgatacctacacaccagctggggaacccatccctactaacaaacgtaacagggctgcacaagtattcagtgatccaaaggttgtcagccaagtgccatggggtttggaatagaacaggagtacactttgctccagagagacgtaaactggcctcttggctggcccgttggaggctaccctggggccccagggattatactgaacaagaatggagctttgttgatcagataataataaagaagggtccatactactgcgctgtaggatcggacaaatcgtttggccgtgacatatcagatgctcactacaaggcatgtctttatgctggaattaacattagtggaacaaatggagaggtcatgcctggtcaggagtgggagtaccaggttggacctagtgtcggtattgaagctggagaccacatatggatttcaagatatattcttgaggagagaataacggagcaggctggtgtagtgcttacccttgaccccaaaccaattcaggagggagactggaatggagctgggtgccacacaaactacaggagcaccaagagtatgcgtgaagatggaggatttgaggtgatcaagaaggcaatcctaaacctatcacttcgccatgacttgcatataagtgcatatggtgaaggaaatgaaaggaggttgacaggtttacacgagacagctagcattgacaatttctcatgggtgtgtggcaaaccgtggatgctctattcgggtggggcgagacaccgaggcgaagggaaaaggggctacttggaagaccgtcgcccggcatcaaacatggacccgtacgtcgtgacagcgctattggctgaaaccacaattctttgggagccaaccctcgaagcggaggttcttgctgctaagaagttggccctgaaggtatga

SEQ ID NO: 5943 - DNA, 450 bp, Oryza sativa
atggcggaccagctcaccgacgaccagatcgccgagttcaaggaggccttcagcctcttcgacaaggacggcgatggttgcatcacaaccaaggagctgggaaccgtgatgcgttcgctggggcagaacccaacggaggccgagctccaggacatgatcaacgaggtcgacgcggacggcaacggcaccatcgacttcccggagttcctcaacctgatggcacgcaagatgaaggacaccgactcggaggaggagctcaaggaggcgttcagggtgttcgacaaagaccagaacggcttcatctccgccgccgagctccgccacgtcatgaccaacctcggcgagaagctgaccgacgaggaggtcgacgagatgatccgcgaagccgacgtcgacggtgacggccagatcaactacgaggagttcgtcaaggtcatgatggccaagtga

SEQ ID NO: 5944 - DNA, 240 bp, Oryza sativa
atgaagcgccctcacgcaccggcaccgagcaggtcgcacgctcgtcccgctgccgtccacattgataacgcatccgtccagtccaacgactgctaccgccggggccgggaccgaaggggcatctggccgggtgcagcggccgacaagtgtaccgcgcaagtgcttttcgcacgggagaacgcacgggatttgggtggtaactgctggatcgggccaatccgcggtcggatttagaataaa

SEQ ID NO: 5945 - DNA, 1236 bp, Oryza sativa
atggagggggaggaggggaggaaggggaaggaggcactgagcggggggcacctctgccacgtgtgcgggtaccagtaccccaacgcgaaccctagcgcgaagctccgccgctcccaccggaagaactgcgggaaggcgccggccgcggacgagcgggaggagggggaggaggtggacgccgacatggagcgcaatgcgggggaggggctcctgccagttagagcaggaggaggtgagtcggaggggaatgcaggctctccatcgctcggatctgcgagaggagatgctgatttggtggaggtgaaggagattgcagagtttagcacaatgcctacttctcaggatatcaatgctctcaagaatgatggtaacgagaagacgccacttgaagacataagcaccaaggatatgactgcatcacttagtgaagataatgttgaagaaaagaaagagaccgaaggcactagtgtgaaggagatgaattcaatactgaaagcagacaatgttgaagaagagaagttgactgatgacacgagtgcagagaggaatgcaatgcagcacatagatgacgctgaaaagaagcaggctgctgacactgtttcgagggaaacgagtgctctacaaaacatagaagaaagggaaaacgttgaaggtactggtgctaagggagtgccagcagtagggagcttggaaaatgctgatgcggagaatcagactgaagacaccagtgcaaagacagaatgtaaatcagataatgctgacaacaagaagcagagttacgacacaagcacagaggagatgaatgccaagaatcaagctcaagatacttcctcaaaggagatgaacaccatacaaaacacatctaatgctgaagaaaagaaccaaactgaagacccagctgtccaggagggaaacaagcagaaggaaggcatctctcccacagtagcgaagcagagttcagaaagagttcatgtccctctcaaggtgctcctagccgaggcgagtgtggagacgaaagaaaagaaaaccactgccaaggagcgtgttttgtcattcaggcgccgagtatcgaaggacgactcatcgtcggccaagtccgggtccccaaaacctggtgctgatgacaacaaattctggagctccccagcaagattgcccgagaacaatgctgagaagaaatccaaagcaaggaagcagccatggatgccgttcatttgctgtcactcggtgcactaa

SEQ ID NO: 5946 - DNA, 3204 bp, Oryza sativa
  misc_feature (2224)..(2224): m = adenine or cytosine
atgggagcttactatggatcatgggaggcttttcttgaggatgtccaggaagtaatacgcaacctgcacactgcatttggtgatcgccctgatgtgcttgaaatggttgttgcattgtctcagagttttgagtcattgtacaagacagaggtgcttgaccttgttgagaaatttgacaaatacctctcggacaagaatgctggttcagaaatgcacgaggagctacatgatattctaactgcagcgaacagcttacctaaagctccatgggaagatggcgtttgcaaagtatgtggtattgatagggacgatgatagtgttctgctatgtgacaaatgtgactcagaataccacacttactgcttgaatcccccactagcccgtataccagaagggaactggtactgtccatcatgtatgttaggtcaaacgaaagcacatcatgatcagggtgttcaagatgtgaaacggcagcaaaagaaatttgttggggaggaagcccatgcctttcaagaggaacttaataaattagctacagcaatggaagagaaggaatattgggaccttaacatgcaagagaggatatatttactgaaatttctatgcgacgaaatgctcaacactgctctaattagagaacatctagatcaatgttcagataagttaggcgatcttcagcagaagttccgtgcttcaaattttgaattgaaagatttgaaatataaggaggagatgaggacttcatatgctagacaaagtagatctagtaaaactgaacagcattttaacaacagttctggacccgtggaaaatcaacagcagtgcacgcccacagcattggaccatctggaagaggctgaacagggtaatgttggagttaacctaaacaacccagctgatggggttcctgatgggcaattgaatgtaggcaagccttacaaaagtgacaaagacatatccagtgcatctatggttgaagaacgcaaatcttcaggactttctgaacaaccatcaggaatggctattgaccagattgatggggatgctattgatgaagggtcccagagttgtgagaagaggtcattaggtgccaagagcagtacatgtgataacttgaacttgaaagacactgaatttagcacacctggaagagagttgcctgatgaaagagccagcacatcattccaagataatcttgaagcatcatcaactaaatcaattgagcttgatgctgataataatgaaatggatactttatcggatgacatttcaaaattgcaggattcaattagcttactagagtcacagattaatatggcatcatcgagaagagagtgtctgggtaaggattccattggtcgattatactgggttataggaagaccgggtaaacgtccttggttggtggctgatggaagcatgctgaaacccaaggagagagatatcagtatggttaacagttatcccccatctgcttttgattgcaaaggttggaattcagcatctattttcatttatgaatctgatgaggaaatccagtgccttcttgactggttaagagactatgacccaagggagaaggaactgaaagactctatcttgcagtggcaaagacatttctgtcatcaaagcagttctcctctcgttgatcctccaatttctggtccaaagggtgaacagcttatggagcttccaaataccaaggctgcagtaattttggaacaaaagtatggtctgcaattggaccaggacacaagtgatctaccgaaaaagcgaggaaagaagataaagttaagttctgaagatagaacatatcgctgcgactgtttggaacctgtatggccttctcgataccattgtttaacatgtcatgagacttatctcatatctacagagtttgaggggcataatgatggaaaatgcagtaaaatccaccagtctcctgatgaaagcagagaaaatgatgagccaaaagtgaaggttaccaaatctgatacgaaggaaaaagattcccttgaatgtagctctgtcattgaaccgtccagtgacagaaaattgatgcaatgcccatatgactttgaagaaatttgcagaaagttcgtcacaaatgattcgaacaaggagacagtaaagcagattggacttaatgggtccaatggagttccatcatttgtgccttcacctgcattttttcttgaacctgcaattgtacaaagtcaaaacmgaaaagatgatgaactcaaggattggacctcctctttagaggaatgcaatgcaatgtctgctcaaaagctagttcaagaggtttccaaatctggtcaaagttgtcctggcaatgtgggtgatgagaaggtgcaaaaatctaaaaagcccacccctgataatacttctggtgaggaagcacattctacaacaggcaagccaacacgattgctagctgttaatggggggttggttccagagtcatccttgaggcctcttataggacgaaactctcacatacttaagcagcaaaagataaacttgcttgacatcgaagcagccttgcctgaggaggcactgagagcctcaaagtgtcagcaaataagaaggcgttcatggcgtgcatttgtcaaagatgcagaatcaatatcccagggcatgataaaagctgagttcttgaagaacgattggtggtactggtcttccttcacagcagctatgaagacatcaactgtatcctcactcgcgctcagggtctacactctagatgattgtatcatctacagtaaggatcaagttccaagcgttgagccagctgacaatacaagatcgatgatagatgatacaaagtcttctgttatgtcgtcgcttaaggagggtagcgtggtagacatcgttccgaaggaagaattggtactccatgtgcgagcattcgatcttgatgccaccatgagtacccggtgcaattttctctgttggactaaccctattcattgtagaggttattccataggagatagaggagacatgtcaggtagggaggatatgtctcattttctacccactttcactctattagccgcagtgggtagtgtagcgggtgttagtttctcattctcatggtctgtacttatgtcgtgtttagggggggcgctctggggcgttgtattgatcatttgtttgatgtttctggcaagtttgcaacatctgataggaatgtag

SEQ ID NO: 5947 - DNA, 1758 bp, Oryza sativa
atggcgacggcgacgcaagctcccacctcgcccgccgccgcgtccgggcgtggctccgttctccccctcctccgtggccgcccctccacccgcgtccgcctcgccgttggccggcgaccgcagaccgccctccgcgcgcagccgccgggggcggcggaggtggtggagcagtcggtgaacaccatccggttcctcgccgtggactccgtggagaaggccaagtccggccacccgggactccccatggggtgcgcgccgctgggccacgtcctattcgacgagttcctccggttcaaccccaagaacccctactggttcgaccgcgaccgcttcatcctctccgccggccatggatgcatgctccagtacgcactgcttcacctcgccggatacgacagcgtcacgactgctggtcctctggggcagggttttgcaaatgctgttggcctagcgcttgctgagaaacatctagctgcccgtttcaataagcctgatttgaaaatcgtggatcatcacacgtatgttatacttggggatggctgccaaatggaaggtgtgtcaaatgaggcatcctcccttgctggtcactggggtctcgggaaactaattgccttctacgatgacaatcatatatcaattgatggtagcacaggcattgctttcactgaagatgcacttgcccgatatgaggcactaggttggcatactatctgggtgaaaaatggtaacacagggtatgatgacatccgtgctgcaattaaggaagcaaaggcagtcaaagacaagccaactcttatcaagaaatatactcctgaaaatcctgctgatgctacaaggaacttatctcaacaatgcttgaatgctcttgctaaagcaatacctggatttcttggaggtagtgccgatctcgcaacatcaaatatgacattactaaaaatgtttggtgattttcaaaaagacacacctgaagaaagaaacatccgttttggtgtgagagagcatgcaatgggtgccatttccaacggcattgcattgcacagtcctggactaataccttactgtgcaacattctttgtgtttactgactatatgagagctgccattcgtctttcggccttatgtggatcaagggtgatctttgtaatgactcatgattcaattggccttggagaagatgggccaacacatcagcctgttgaacagttattcagcctccgcgccatgccaaacatactaatgcttcgacctgcagatggaaacgagacttctggagcttacaagattgcagttcttaataggcaaaggccctctgtccttgccctttctaggcagaagcttcaacagctgaaaggaacatcagcggaaggcgttgccaagggaggatacattatttctgataattcatcaggaaacaaaccagatatcattctcatcggcactggttctgaacttgagattgtagaaaaagccgcagatgagctgaggaaagatgggaagactgtacgagtagtttcactggtttgctgggaattgtttgaggagcagtcggagaaatacaaggagagtgtttttccaagtgaagtaacttctaggatcagcgtcgaggctggggtcacatttggatgggagaaatatatcggagaaaaaggtaaagctattggtgttgaccgttttggttctagtgcgcctgctgggaaaatatacaaggagcttggtttgacagtggaaaatgtcattgcaacggccaagtcactgtga

SEQ ID NO: 5948 - DNA, 2694 bp, Oryza sativa
atggcgtcggagaccgagacgttcgccttccaggccgagatcaaccagctgctgtccctcatcatcaacaccttctactccaacaaggagatcttcctccgcgagctcatctccaaatcctccgatgcattggataagattaggttcgagagcctcacggacaagagcaagctcgatgcgcagccggagctgttcatccacattgtccccgacaaggctagcaacaccctgtcgatcatcgacagtggtgtcggcatgaccaagtcggacctcgtcaacaacctcggtaccatcgccaggtcggggaccaaggagttcatggaggcgctcgctgctggtgctgatgtgtccatgattgggcagtttggtgtcgggttctactccgcctaccttgttgctgagagggttgttgtgaccaccaagcacaacgacgacgagcagtatgtgtgggagtcacaggccggtgggtccttcactgttacacgtgatacctctggtgagcagcttggacggggtactaagatcaccctctacctcaaggatgatcagctggaataccttgaggagcgtcgcctcaaggatctggtgaagaagcattctgagttcatcagctaccctatctccctatggactgagaagacaactgagaaggagatttctgatgatgaagacgaggaagagaagaaggatgctgaggagggaaaggttgaggatgttgatgaggagaaggaagagaaagagaagaaaaagaagaagatcaaggaagtctctcacgagtggaacgtgatgaacaagcagaaacccatttggttgaggaagccagaggagatcaccaaggaagagtacgctgctttctacaagagcttgacaaacgactgggaggaacatctggctgtcaagcacttctctgtggagggtcagcttgaattcaaggccatcctgtttgtaccaaagagagcgccatttgacctctttgacaccaggaagaagcaaaacaacatcaagctgtacgtacgccgggtgtttatcatggacaactgtgaggagttgatcccagagtggctcagctttgtcaagggcattgttgattctgaagaccttcccctcaacatctcacgtgagatgctccagcagaacaagatcctgaaggtgatccgcaagaaccttgtgaagaagtgcgtggagctcttctttgagatcgctgagaacaaggaagactacaacaagttctacgaggctttctccaagaatctcaagcttggcatccatgaggattccaccaacaggaccaagattgctgagctcctgaggtatcactccaccaagagtggtgatgagttgaccagcctcaaggactacgtaacccggatgaaggagggccagagtgagatctattacatcactggtgagagcaagaaggctgttgagaactcccccttcctcgagaagctgaagaagaagggttatgaggtcctgtacatggttgatgccattgatgagtacgctgttggtcagcttaaggagtttgaaggcaagaagctcgtctctgccaccaaggaaggtctgaagcttgatgagagtgaggacgagaagaagcggcaggaggaactcaaggagaagttcgagggtctgtgcaaggtgatcaaggaggtgctcggtgacaaggtggagaaggttgttgtctctgaccgtgtggtggactctccctgctgtctagtcactggggagtatggctggactgctaacatggagaggatcatgaaggcccaggctctgagggactccagcatggccggctacatgtctagcaagaagaccatggagatcaacccggagaatgccatcatggacgagctccgcaagcgtgccgatgcggacaagaatgacaagtccgtgaaggacctggtgatgctgctcttcgagactgccctgctgacctccggtttcagcttggaggaccccaacaccttcggcaccaggatccaccgcatgctcaagctcggcctgagcatcgacgaggacgagtccgccgaggctgacgccgacatgccgccgctggaggacgacgccggcgagagcaagatggaggagagatggagcacatatgcgtttttgcgttgtgaggacatcgtgaggtacgtgtcggctgatctgctggctgagctcacgtgcatctgtatcggatcggaggcagaggttagagctctatccacacacataaaactagtcttggattctactagtagtaggccaaaagcaacatccattataaacagtgttggatactaccaggtcaagtacacattcagagaaacaaggctgcactcttgctgcagatcaagcggaggacttgcaatggaggcaaccaaggagacccagcagcagcagcagcagaggaagccggacgccggcgacacggtgcagctgccgatggacaccagcccgtacgtgcagtacaagaaggacgacggcctggaggactacaagctgcgcgcctacggcgcccgcggccacctccccgtctccgacgtcccccacggcggctgcggcaccgacgcccccaccatccccggcaccgccgtccccgtcgccacacagcgccgccaccaacaaggcgacaccgccgctgccgccgccggcaccggccgcgttgacaccgccaccgacgccatcaatcaccatggcgtgccatag

SEQ ID NO: 5949 - DNA, 963 bp, Oryza sativa
atggggatcgtcggtgctaggatatacgcgagactgaggcccccgaattgtcaagtaataaccctacatcctgttggccgaagccgggtagccttccacctcgaatccgtgcccggcgagatcagagatagcgctttcgtctctcctgacagtatccggagacaccgtagggtactagccgtgcttatccctgaagtcgatatccggcggcgtgtcttggcatatgtaggcttctatgttgtggcttctatgtcgattgtgttgggtgttgatcctccccctctcctcctaggggagcttaactctggttgtctttccttatccggaactcctcctatatccgcaggttatttccgtataggacatggtatgtgcaacggcaagaatggcggtagtagggcttcctcccttccccggtgccctaggactagcatggtgaggatagggagtggatctagcgtgcgtgagaaggtcaaccgcctaggcgaggggatagttggatctagttttcctaggccaaatatggtcaaggaaaccagatctggcaatgttgaccatctctatgcgtcaggtggcgtcgacacaaggtggctgcggaggagtggaactggagtagggtggagtcggcatggacacatggttggcaggtggggcacggtcatagacatagctggcagagagctggagaggcaacatgaagaggttgcatggagagataagaggggcgcttggagaagacaccgtagaagggtgactcggatgcgcacgattgctggtgcttcttgttgggcgaaaggccaagtagtggctcaagcaatgaggacacgctcctcctctctaatggtcggtctacttccggactctggtcacggggagctccatggtgatcgagctaacccatttggtggagatgcggtgcacgaggcttccatggctcaaccatgcattggtgtgttagagtag

SEQ ID NO: 5950 - DNA, 447 bp, Oryza sativa
  misc_feature (172)..(172): n = any nucleotide
atgagcaacatcaagcttgagaagtggtacagatcatttctcccaccaaggatgacttcatcaaatactcgtcaggcgttcatctacacctacaagacaaccattttcggctttgcggtgaacatcaccgaagctgaaaaagattatgtcatgaagaataacggcgtccttnaagatggtgcaagcgtgtttggcaatggaaatggcacagcagctggcatggctcctcgtgcacaccttgctatctacaaggtgtgcagcgataaaggttgccgtgtatctgacatacttgctggcatggaggcggctattgctgatggtgttgacatcatgtctatgtctcttggtggtccagcgaaaccattttacaatgatataatagccactgcatctttttctgccatgaggaaagggatctttgtacactactgggcaaatgcctggtag

SEQ ID NO: 5951 - DNA, 1854 bp, Oryza sativa
  misc_feature (54)..(54): n = any nucleotide
  misc_feature (72)..(72): n = any nucleotide
  misc_feature (117)..(117): n = any nucleotide
  misc_feature (511)..(511): n = any nucleotide
atggcattggcatcagacaagttcgtcctctccgccatcgtgctcgccgtcctnaccgtcgcggcagcggcngcgggctacggcggctacggcgacgtcggcgagtactgccgcgcngtgtcccggaacccggtcccatcgtgccggaactacatcgcgcggtggtgcgccgtcgccgggggccgcctggactccggcaagcagccgccgcggcagctcctggagccgtgctgccgggagctcgccgcagtgccgatgcagtgccggtgcgacgcgttgagcgtgctgcctcatggtcaagactatggaacctatacctgtcctgatggtgaagagagtgccactctgatgcatgcggtgcatatgcttagtgctatggatgcagtaagtgtggagcgagacaaagcagctcatgacagggaaaactggaatcgaggcaagatttgcaagttggagagcaagatggtgaacacgcgcaccggaagtggaagtggaagtggaagtggagctnctaacaatggaggagatcccacgctagctcagattctggcccaacaaacacaactgatcaatctgttagtgcagcaggcacagaatcagcaggtaaacaatcagaaccagaatccacccccacctccccaaaacaagctggcagatttcttacgtgtgagaccccctaccttttcaagcaccaccaatccagtagaagcaggagattggctgcatgcggtggagaagaagttggatttgatccagtgtactgagcaggagaaagtttcttttgcttcgcatcaattgcatggtcctgctgctgaatggtgggatcattttcgccaaggcagggctgaaggagagcctattacgtggcaggaattcacggccgcttttaagaagacacacataccaacgggtgttgtagctctaaagaagagagaatttagagcactcaaccagggatctcgttcggtcaccgagtacctccatgatttcaaccgtttagctcgttatgctccggaagatgttcgcaccgatgaagagcgtcaggagaagttcttggagggactgaatgatgagttgtcttatgccttgatgtctacggatttccgggatttccagcagttggtggacaaggcgatttgtcaggaagacaagtataaccggatggagcagaagaagcgcagggctgcccaattcaaggcacaacagggcagtaaccagaggccgcgcctcgttacgggacctcaagtttcatcgtaccctcaaggaggatcttcatcagttatccgcccccaacgccagttctacaacaacaatactggtaatcgtggcaatgacaaccgcaacatggttgctcgtcctgcagctactccagttcagaaccagcccgtcaggaaggaacaggggaagcaagccaggggtgtgcttcaattgtggcattatgctgataagtgtcctaagcctcggcgcgtgaagaacgctccagccccgaacaactccaatgttccagcaccgaaggcacgtgttaatcatgttgcagcagcagaagctcagaatgcaccagatgtggttttggaaatagaagaagttcctttcccattctcgcttatcttgctagaatccaaagatctagatgttatcttagggatggactggttatctcgtcacagaggatttatagattgtgccaaccgtaaggtgactttaaccagtagcaatggggaaaccgtttctttctttgtgtcctctcctaaatatcatggtgtgatcttaaaccaagttgctctacaagagatccccatagtacatgtcgcgtcccaaaacgactctaaaatacatcctcaaaattgtgcctaa

SEQ ID NO: 5952 - DNA, 1113 bp, Oryza sativa
atgaggaggatcacgtggctcgcgacggcggctgcggcgctgtgctgcctcgtcgcggcggcgagtgcgacggcgcagtgcaggttcccggccgtcttcaacttcggcgactccaactccgacaccggcggcttctgggccgccttcccggcgcagcaggcgccgttcgtgcaagcgatggggcttccgctgctgagcccttacctgcagtccgtcggctccggctaccgccacggcgccaacttcgcgacgctggcgtccacggcgctgcagccccaacacctcgctgttcgtcaccggcatcagccccttcttcctcgctgtccagctcaaccagatgaaggagctgaggaccaaggtgctcacctccaatggcaacaacgagatagtattgctaatctagttaagattaattttcagaccaacttcctgcacctgatgttctgcacaatgctctgtacacaattgacattggtcaaaatgatctcacctccaacctgggatcacagagcattgagacggtcaagcaaagtctccccttcagttgttagcaagatctcctctactgtgcaggaattgtacaacattggcgctcgcaacattatggtgtttaacatggcgcctatcggatgctacccggcattcctcacgaaactcccgcataccagcaatgacatggatggatatggttgcatgaaaacctacaacagtgcagtgacctactacaatgaactgctgaacaatagcttggccgaggttaggaagaagctgcaggatgcatctattgtgtatcttgacaaacacgctgtgacgctcgagctgtttcgccatcctaaagctcatgggctgaagtatgggactaaggcttgctgcggatatggtgatggggcttacaatttcaacccagatgtgtactgtggaagcagcaaattgctgaatggccaaacggtaaccgcaaaagcttgtgctgatccacagaactacgtgagctgggatggaatccatgcgacagaagctgcaaacaagatcatagcatcttccttgatgagcggctcatattcatatccaccttttgatctttccaaactttgccacctacagcccatagcataa

SEQ ID NO: 5953 - DNA, 312 bp, Oryza sativa; identical to SEQ ID NO: 1107

SEQ ID NO: 5954 - DNA, 714 bp, Oryza sativa
atgggaactgtttggtatggcattcctagctctaatcttctacacacatatggtctgctgcatgtgttgaatggtcttgtagatgtttccatgcttggtgtagtgactagtgccttcaataacatattaaaaccacctgaagatagtacagatgcacctgctactgcagcttgtaaactcagcataccatcaccagattacagctgttgcacctcatttccatgtctgacaaaatcacccgaggcagttgaaggatcgaggaaagaaattcagagatgcttcactttggaagaagctaccgatacaattctcctctgcagttctattgttcatgaccttgcatacaaggcagcgacaattgcactggaccatgagcaggaacgagtacacgcagagcctactcgcccatctgttaccatcgttggaaagtctattccaaaggaggatggtttacttaagctgactcacagacgaacgcctaaccgtaaggttaaaaggaaaagattggaaggtgaaacaaccataaccgaaaatgctgaaaagaaagatgatatctctacagaccactcacccgtgcgttcctcttctggaattacaaggacatctgagagcatgaagcctccaaaactggaatccaaaccaggatctataggtgttcttgcatgcatctgtcatcatcagcactgcttcaatcacttgtatgacaacctatag

SEQ ID NO: 5955 - DNA, 1452 bp, Oryza sativa
atggggaattcttgccaaaatggaacctatgggaacaattaccagaacagcaaccggtttcagaatgaccgttttgcttctcggtacgttgatgggaatgatactgaggattgctactcgggctcgtcaagggccagcttagcgggtgctctgcggcaagggctgaacctaaagtcccctgtccttggatacaagactccaaatgtaagggagctctatactcttggccgggagcttggacagggacagttcgggaaaacatacctctgcactgagattagcacagggtgtcaatatgcatgcaagactatcttaaagagtaatctccgatgtgtgtcagatatcgaggacgtgcgccgtgaaatccagataatgcaccatctttcgggccagaagaatatagtgacaatcaaggacacatatgaggatgagcaggccgtgcacatcgtcatggagctctgtgcaggtggtgagctcttcagcaagattcagaagcgaggtcattacagtgaacggaaggctgcagagcttataaaaattatagttggcatcatagaaacatgccattcacatggagtgatgcaccgggatctcaagccagaaaatttcctcttactggacgcagacgatgaattctcggttaaagcaattgactttggtctatctgtgttcttcagaccaggtcaggttttcagagaggtagtgggaagtccatattatattgctccagaggtattggagaagcgttatggaccagaggctgatatatggactgctggagtgattctctatgtattgctgactggtgttcctccattttgggcagagcatccatggatatgtgataatggagtggctactaatcgagctctggatccaagtgtacttcctcgtctcaagcaattttctgcaatgaataggttaaagaaattgtctctccagattattgctgagcgtctttcagaagaggagattgttgggttaagagaaatgttcaaggctatggacaccaaaaacagaagtgtggttacatttggtgagcttaagggactgaaaagatacagctcagtgttcaaggatactgaaattaacgacttaatggaagcagctgatgacaccacctccaccatcaactgggaagagtttattgctgcagcagtgtctcttaataaaatagaacgtgagaaacacttgatggcagcctttacatactttgacaaagatggaagtggttttatcacagttgacaagcttcaaaaggcttgcatggaacgtaacatggaagatactttccttgaagagatgattctggaggttgatcaaaacaatgatggtcaaatcgattatgctgaatttgtcacaatgatgcaaagcaacaactttggacttgggtggcaaacggtggaaagcagcctgaatgtagccctgagggaggcaccccaagtatactga

SEQ ID NO: 5956 - DNA, 2058 bp, Oryza sativa
  misc_feature (1377)..(1380): n = any nucleotide
  misc_feature (1482)..(1482): n = any nucleotide
  misc_feature (1738)..(1738): n = any nucleotide
atggcaaccatcaaattccctatagttttctccgtcgtttgcttgttcctcttgtgtaatggttcgttagcccaacttcttagccaaagtactagtcaatggcaaagttctcgccgtggaagtccaagagagtgcagatttgatcggttgcaagcatttgagccgattcgcactgtaaggtcccaagctggtacaactgagttttttgatgtctctaatgagttgtttcaatgtactggagtatttgttgtccgtcgagttatcgaacctagaggtcttctgttacctcactactccaatggagcaactttggtatatgtcatccaaggcagaggtataacaggaccaactttcccaggatgtcctgagacctatcaacaacagtttcagcaatccgagcaagaccaacaattggaaggccaaagccaaagccataaatttagagatgaacatcaaaagatccaccgttttcaacagggggatgtagttgcattgcctgctggtgttgctcattggtgctacaatgatggtgatgcaccaattgttgccatatatgtcactgatatatacaatagtgctaaccaacttgatcctagacacagggatttctttttagctggcaacaataagataggtcaacaattgtatagatatgaggcaagggacaattcgaagaacgtctttggtggatttagtgttgaactacttagcgaggctcttggcataagcagtggagtagcaagacaactccagtgccaaaatgaccaaagaggagaaatagttcgtgttgagcatgggctttccttgctccaaccatatgcatcgttgcaagagcaacaacaagaacaggtgcaatcgagagactatggccaaacacaatatcaacaaaaacaacttcaaggtagttgctctaatggtttggatgagaccttttgtaccatgagggtaaggcaaaatatcgacaacccaaacctcgcagatacatacaaccccagagcaggaaggatcacatatctaaatggccaaaagttccccattcttaatcttgtacagatgagtgccgttaaagtaaatttatatcagaacgcactcctttcacctttttggaacatcaacgctcatagtgtcgtgtatattactcaaggtcgtgcccgagttcaagtcgtcaacaacaatggaaagacagtgttcgatggagagctccgtcgtgggcagcttctaattataccacaacaccatgtagtcattaaaaaggcacaaagggaaggatgctcatatattgcattgaaaaccaaccctgactccatggttagccacatggcaggaaagaattccatcttccgcgcacttcctgacgatgttgtagcaaatgcatannnnatctcaagagaagaagctaggaggctcaagcacaacaggggagatgagttaggtgtgttcactcctagtcatgcctacaagagctaccaagacatatctatntctagagcacccgaacaacatgatgaacttgataaaagattattgtgggctgaactttccaaaacaagtaggttgcttgatgacaatacaaccggtacgaatgagttgaatgttgttagttcccaacatggagaacaattgaatgcaaaagatcaagatgaactgcaaaacatcaaggagaaggtaagaaacaaggggaagctgattgcgctaggaagttcccctttgaactccgcgatcaccagtggtcctcttngacacgaggaggaggatccaaatgatgaaaatgagaaggggcaccaccgagtcgcccacaccggtcatgacaatgacctgatatgcaaaatgatcaaggaatgctttgatagtattaatcaatcaactgaacaaatgaatcgagctttagccacagagattgctcctcatcaatcttctaatgagcctagagaagtaccaactgaagtagagcataatatgctttctaatgtagaagcaccagttctagcccaagttgtagaaaatatctttcaaaatgaagaaataatagcatcaactgaagaaaccaccactacttga

SEQ ID NO: 5957 - DNA, 1263 bp, Oryza sativa
  misc_feature (9)..(9): n = any nucleotide
  misc_feature (365)..(365): n = any nucleotide
atgggggtngggtacagcgcggcggggttggcctgggggtcgtgcacgacgggggccctgaggacggaagccgaaggggacgggtggtggaagcggagcgagatccaggtgaggagcacgaagagggagagcaggaatgggaacgacgccggccgcttcaggaagtggaccagcgacgacggcagcgagggggacggcgcggcggcgggggcggcggcgaggggcgtcgtctgcgtgtggatttgcagcgcgatggctctcctcgggttcgccatggatgggtgggcggcgagctgctgctgcttgctgctggtggtggtggcgctgcccggactcggccgccgccgcggcgagctgttgccggngaacagcccgagccggctcctccgtgagctcgcggagcggaagaaggccgtgtccccgaagaagaagcacccgccgcggcgcttcatcctgaagccgccgctcgacgacgagcgcctcacccagcggttcctcagcagcccgcagctgtcgctcaaggcgctcccgctgctatcctcctgcctcccgtcggcgccgctctccgccgcagaccggacatggatggacgagtacctcctcgaggccaagcaggcgctgggctacccgctcgccccctccgagacgctcggggacggcgacgacgacggctgccccgcgcggcacttcgacgtgctgctctacctcgcgttccagcacctggacacgtcctgcgagcgcacgcggacgcggcacgtccggagtggccactccaggctctggttcctgggccagtacgtcctggagctcgcgttctgcgagttcttcctgcagaggtacccccgggaatcccccgggccgatgcgggagcgggtgttcgcgctgatcgggaagagagcgattcccaagtggatcaaggcagctagccttcacaatttggtgttcccttatgacgatttggataagatgattcggaaggaccgggagccaccagcaaagtggttggcagagaagcatcggaggttgctaatgaacaaatactgcggacgatacctccgggacaagcacctgcaccactacattatctacggggagtcggtgcaagacagatttgaacacaaccgccggctgagaaatccttccacgaccgccgtccagcaagcaatacacggccttgcttactgcgtctatggcaaaccggatgtaaggcgattgatgttcgaggtgtttgacttcgaacaggtccagccaaaagcagtatga

SEQ ID NO: 5958 - DNA, 864 bp, Oryza sativa
  misc_feature (103)..(103): s = guanine or cytosine
  misc_feature (115)..(115): y = cytosine or thymine
  misc_feature (117)..(117): s = guanine or cytosine
  misc_feature (120)..(120): y = cytosine or thymine
atgccgcagaggcatacaaagctcatcacggccgtccagatccgatcggacgcctcctcctccgcctccaatggagcttcccctggacaaggccgcggcccgstccaccccaatygsgtycccgccgctggggcggcggcggcggcgaaccagtccccggcgtctctgccactgggaccacccgcggccgcctccgccaagcccctcgtcgcggccgccaacccgccgctgctgccggtggtggctccggcggcggcggcgcccaagtcgtcgtcaggggccgtggaagagagcaaagagggtgtggaagagagcaacaagagcaatgtgttgaccattggcagcatcaggagcacgctgatgaagcatgaggacaccatcatcttcggccttctggagaggtcacagttctgctacaacccggacacctacgaccccaacgcttccaggatcgtccggttcaatggctccctggtcgagttcatgatggggaggtacaagagcccggatgagcatcctttcttccctgagaatttgctggaggtggtggagccatctgttgagtatgagaatgcactctccaagaggattcactatggcaagtatgtggcagaggctaagttccagggggcacctgacactgacaagctgatggaattgctgacgttcgcgaaggtggaggatgacgtgagggcccgcgtgatgagcaaggccatgaccttcggccaggtggtgagtgaagatctggagaacgaaattaagctcaagatcgagccggagctggccgtggagctgtatgacaagtggatcatgccactgaccaaggaagtgcaagtgcagtacctcctcaagaggctggattga

SEQ ID NO: 5959 - DNA, 1858 bp, Oryza sativa
  misc_feature (460)..(460): y = cytosine or thymine
  misc_feature (600)..(600): r = adenine or guanine
  misc_feature (783)..(783): k = guanine or thymine
  misc_feature (803)..(803): r = adenine or guanine
gataacgtagttacaatgcaattacacaatgcagttatagtagggtgcaactggagtataactaacatgtaactcaattaattttttaaaaacatgcaacagatctaagtggctagcacgcacggcttgtgggatggatatcctaggttcaagcccttgcaaggacacaccttaattctcgcgcagatttttttttccaaatctcgcacgaatcatggcgtggatcgcacggccagaaaatcaaaagttttcagcctccaaaactgtcgacggctagctagcaaaaccgtaaaactaaacttactgtaaaggagaaacacggaatctcgcggaacttgatcacatagggaaccctagctctctactatataattagccaagccatcatggagagagatcaaaatctctgccaaatttatttcttccttcccaaatgaggggtgcagtccaccccccctcyaccccatgtggtacaatgtgcagtggcagtcccccatcaaggcaagcaagcaaccatagtgatcaatatgctagctgcacatatacctctctctctctctctctctctctctctctctcttagctagctagcaacaaacragggagctagggttttcttggctctgttgccataagcagcaagtgtaccctgtccctggagagctcctcatggccatggccaacctaacaaacctagctgccaagatcggcaaggaggaggaaaccgggtgggcccacactgtcagagggtggttacaagtccacacacatgttgctttccakggtgccttgtgaggggcatrcagagagttgctataggctacatacaccttcctcgcaattgcatgtagtgttcatgattttataccatgcccatgtatatatagctgcactgtgctctgatgagtaatactgttgcattatattgcatgagctacatacactgatatctctgaacttttgtgtgcgtgatatatgcactgttgcagtgtgtgttttgtgtcacaagctaggctcgtgtatttgtgcagagatcgaccagagagtatatgctagtgcatcatcattgcatgctgcaagtacacacatggatatgcacactgatctgatcatcatcatcatgaagtcatgcttatgtctgcatccgtttcttgctttgactcactatctgatcctaattacacactgatgcaggggtaaatgtaaaactagactagctagcatattagttacagttaaaaatgtagtttgttgctttctggatatttactactccctccatctacttttgatttgatttggagtagtacactgatttgatttgcaggagtagtagtgtgagagtgtgtgacagagagaaagcattgtgtgttgcacattactacaagctctctctcctatatatgtctctccttctgcacctcctgccttagcctttgaagcaagcttagcacttcacaaggtatgtacatagcacattactactcctgccctatctatctaccctgttcatgagtaattcaagaaaaaaaaaaggacaccttttctagctagttcttcatcctttcgcagcaaagagtttttacatctctagctactagttgttcctcttctctacatgaaattttttctacttctgattgcaccctttacatagctgtggggggaaatccaatttgagcacccatgccttatgttgattttaacaaaattcgtccatgtatcgatatgttcataacttggccatttctgttcttcttcttcttcttcttcttcttcagtttcctcttgtgcagaagaaggagaaacaaaagaacacagaaattaaattaaactcgatcaggaaggtatagcaggc

SEQ ID NO: 5960 - DNA, 1970 bp, Oryza sativa
caaattttgggtcatggattagtttcacgcttataaaaatatttacttcctaaaatattttcttctactatatgaagttatttctgaagtttattttctaaaatatatttttttattaatcaattaaacaatccgtctcaatagtctgtgaaaaaaaatatatttcaacagtgtctaaatgaaaaataaaaatcgaattaaattaggcgaaatgaaaagaaagtccctgaccgaatcacgcgtggacgaggcggccgcagacagcaccacggccagtgcagggggggcccaccggcggttggtggcgggcgagcggccgcccggaggtggggcccacctcgtcagtgtcagtgtgtgcgcgtgtgttggtgggtgcgggtcgctgtccgccacccaactcctccctccccacgtcgcgcggcgcccaccgtccgatcccgaccgaatcccatcgtgcggccgcgcccacccgcctcccgtggtgagggggggcctataaatgggccgcgcgagaccaaggcccatctcgccgtgcccggtcggatctaattaatttacctcctccacctcctcctcctccccccgatcggatcggcccggctcctcctcctccgccgccgccaccgccgccgcaggtgagccgccgattcccctgtcctcgttgctggtagcgttgtcgcgtgtgtgttgctgctgctgctgctgctgctgtccggcttctcccttcattcttgcggcttgaaaagggagaggagggttttagcgttcttggtaggatcaagctctcaggttggatctgagctcgtggttggttgtcttgcggacgtatcatcgtgcctagatattgatttgtttgtgctggtttgggagggttataaggagggtttattgcttttctttcgatcttgtggtatggtagatttagatggggtttctttggttggatttaggtgttgtaagttttatttttgtcatgcttgcttattattatggatggagatggagagagaagcagtaggatgacttccttttagatgtttaataccttgatgcttatcaaacggcttgctgataaacaacatgctagagcagtggttttagtgctagtattatgtctttggctgtcagctcatttgactgttctgcggtagattcgagtcatccccttggtcttgggagttggaattcttataaatgaacggaaaatggaaaaaaaaattgattggtgccacttcaaagttaaatatgccaagacgaattgatatgtttctgctgttgttttatgctcttgattagttgatgcgcatgttcaatgatttatgatgtttgtctttgtggaaagattacatgtaaagagtatagtagaacccctaaaagctagccagcgatttcgctctttttttccaggtctccatgatatgtttacccctaaaagtggtatatttatgtgatagttacaatacatagtggcaccacgattgattatgcgtttatgctgattccggcagaaaattgttagattccttgtgctctatacctgcttgttgcgcttgtagagaatattacaaatacctaacacttgcccaaggaacttaggaacttagtcaactctttgtagggacaactattttagcccaaaattgtggtcttgtcaggtgccaacaaaacagcatcttggcgtacataagctatatagaggattaaaaggaatgttttgttccttgctactgtttttttaacctgtttactcaggacaaattttgttgcataaaccatttgttctagggatcagtattgtcctctcagtgtgttatgtaagcatttccagaaatcaattgtcgctatcagcttccctcacattagctatcacttatacccctttttttctcataggctcaccatgtccattttattcatgatatttctttgtctaaagtatgtgaaataccattttatgcagataggagaag

SEQ ID NO: 5961 - DNA, 2003 bp, Oryza sativa
  misc_feature (134)..(134): k = guanine or thymine
  misc_feature (1557)..(1557): r = adenine or guanine
tgtgctgtaatagcttgcctttgctaaatctcaagtgcttttccattgttttgcatttctgtgagacagaatcctgtttgaaatgaatcactttccattcaaacagtgtagagttgattggctatccaatattkgcatataagaaatctatggacttctatatatttatatcattgagttgtagcttattatagaacttattttattctgtaatctatcaagttaaatgatcttttgtcatacttggtcaaaatggtgcttattttttggtatgtgattctttaccaaattaaattatcactctaatgttgttatacttatatccaatttttaagctttaagagtaactgcagctgtagtcatttgaagttttatgtaacaccgaactttcttattaaaaacttttaaaacaataaaatatctatgtatggtagcttttctgacaattaagacagttgctaatctgcaataattttttaggacttcactacaaaggcaagaaaaaatgactacagatgctcacaccacattacctcacctagaatttgtcttaagtaatagatatgaacaaattgctttcaaaagactgctatatgaaatatcagctagacctcattcattaatttgtttgcaataaacaaaagagataatgatggctgtttctgcaatattagtacttgaaggagcaataccaccttaggcatttgccattttatgttaaagtattctgcaagataaactgattcagctgaaagttgttaacagtatatatctagacattgtattgtctaatcattctcacattgtgatgacaaataatgtcttcaagatcaatatgacattcataggttccctgaaataaccaaaataaaatgtgttacatgaaaataaggacatgagaaaggaactgaccatggtcttcctcatctgcagatccatattcatcatcatcgttaagatctacgacctcagggccagcattatcactctcaagcgcttcaagacgagctagtgcagcctacatgccatcacataaatgtagacagaaattagagaaactaaataactgggaatcagtaaatttcaaatatccatggataaccaagaaggcaaaattcttttgtactgaaaactctgaatcctaaacagaagacgagtaaaaatgaaattaagagtacatggaaagaattaaagctctatatcctgtagagttccttctttgacaaagggtcataagcaaaacattagtgctggtataattaaggcagagcatattcgccacatatatgagcagtagaaattctacacaaaactcttcatgcaaacatctgcagaggtcatttactaaaactaccggtcaagatggcccaatcctttcaattgctctattttaacacaaacaaaacctgcaatgtgtggcccttaacattggagcaataatcaagcaaagtctggagcaggcgtttgttaccatgaaggttcagtacacaagcccaatttgcaactataattcagaacaataatcaagtgtatttggagggatttcacaaaaaaggraaataatatggagaaattagcggtggccactggcctggatattattaacacgtctctacctctctaaaaaaaaaagtccattacaagctttcattgcaataagagaaccacaatgttcagagaacgccccaataaagggttgacacaaaaccacattaggtacatttcaaactgtaaaaactaatttctttccttttcttaatctccatctaatactggtactacaccttctgaacggccgtgagaagtgacaagacaagtcgactactcaagtgctaaatcaagagatagtattgaatacagcaagacataggatgaaatggatgtaataatatctttggattccaaagtcgactaaatcaagtgcaagtaaggaagagataaactagggcaagagctttaatccggagacaataacaattactactactaagcagctgttaatg

SEQ ID NO: 5962 - DNA, 1923 bp, Oryza sativa
gcgcaaaacggtataggtctgaacgctatgaatccctgagtggtcccagttaagttaggttggtctgattatctactgctactatgtcaaaattttcaattttgttattggtaaattttggtaaaataagtatcatttggtgcatgcacatctcctactttactgtaagttcgtaactggtgagtttagtccacatcagtattaaaagttgagggcagtccacatccatcaattagcatgtggtagagatggcccatggttgatgagctagattgcgcgctccaactgtaacttctataataaagaaatttaaaatgtttgtaatgctacctagcactaaaatctgttggtgaattaactataggtacatatattatattactatacctctccatggagtgagttccaaaattaatctcataattaagtaagagcaaaacgaggaattcctttatattttgtcctcaatgttttttcttcaattgttaagaggataatatcttatcctcttaataattaaagaaaaccgttcagaaaaagataagataaaactcatcgtgttagcttattatgtaccttttattaatctctactattataaaaattaaagatgtttttaccgatactttggtatgccatcgtgtatgagtcggtttttaagttcgttcactttaataaatacatatctgtatttgagacgggttttaagttcgttcgtttttagaaacacagaaggagtcatataagaaatctcttaaaaaactcgcttgctaacttgagatgatcggactcctaattatagctaatgattttctatatatatatccaagctgatttccacagtgaattttaccttaactaaactatataacaataataatattattagaatagctttcacccgttgcaatgcatgggcattttttatctattatctcttaatgttcagaaaaatctttgcattttcacctgcatatatttgttctaattagttcaaccgaattaaaaaatttatcctcaaatagtagggacatatatacctttccaacaaggagaggaaacctattcaatcaaataaaagaattgtttgaaccacttttccccgaaactgactttcaaactactagaaacttatgacaaagaggtttccagaaatggtcgtttttttttcttatatcaagattattgtaccaatgtgagatgaattctttggtgttatcaatatttttgtaacgttggaagtattccttccgtaaaagcaacttgatttttatctatgcaactttacaacttatcatttgggatgaaggaagtaggatattggtgaggtatttactctattaccgtataaacattttggataaacccatgttgctctcccttcctatcgtcttattcaactctacattttgttaagaagtgtgtggacgtatgagcatgagtatgtactacctcatgacgagtggtttcaatttcacccttttgttgagaagtgtatgaacatgctagcctaaatactccgtaaaattcctaaccaaagctaaatactccctaccatttattttaaaattttaaaaaacccacccttttgtttgtatatagtcagtgagtatgttcgatcggccacttggttgtaatactgcttgtataacgttacatactcggcaatacaccccggctgtgttaatttggcagcgtgtgctgttcacttgtacattactcatcaagtggcggacaagttgtagaaatgtagaggccaaaccatcaaaaagccaaactactccacacaagacaccgtatgcacaaacgatcaacattcccatcatgcccatccagcgtgacatcaaaagcggcgtcctaggaagccagccaccattccatgccttcccctgccgattccaccccctgctactaccagtctct

SEQ ID NO: 5963 - DNA, 1003 bp, Oryza sativa
caagccgctttcacttgacggaacttgctcaggctgtttgatcctacacgcagagttataagcttttaattagatgttattctaagctatgagaatgacccatctagatcctttttgtatgttcaataaagtgcagcctacatatatctaaagaaaaatgtcacacgaaagggtttgtattggttaacagctatttaagcttatggtacagcagctgcagacttctctgagttcagatagacaaacaataatctaatcttaacacatagagccacatttcttaaagtatttaacaaaaaatatggttgaatcaaaggtacggaaaacatgcttgaactattgcatcagattaaaactagtgacctgaaagaatctaaataattttgacacaagccttacctgtagttcaaggtatacactacaggtgaagttaagattgattttcatctcactgtaggtccaactttttttactataatacttgcaaaaaaaagaaagaaagatttggccttccctctcaaaatcttcacaaacacataaaacttcaacttgaaagcgcggcagagcgcacttagctttcagaaatcagaattatgcgacgtccttaatacgacacaatatgctgatgcttacgaatattgcagcaaggcacaagagaatacatgaatgaaactacatcaatctaagaataaagaacaaccattgtgtccagtttccagttgcacccaccgccaccatatattgtggtagaaacagtcactaggcaaggtatatctctaccgtctctgttggtctcatttggcacttggacccgtcaaatatagaatatgatactataaaaactattaagaggcatcataagcaaactgtcactatcttttaatcaacagtcatatcgctccaatccagttacttaagcacatatggccaggaccaaaccacaatgccagtgagaccttgactaaaatcatgatccctaactttataccggtgcaaataagcc

SEQ ID NO: 5964 - DNA, 1993 bp, Oryza sativa
  misc_feature (319)..(319): m = adenine or cytosine
ggagcatgtactctttataactaactttacatgtcatcctctacttatcttctcttcctctcttcctacttctctcgatcttgctcctcgtagccccatcattattattgtcgccactttcctatcaccttacatgatttgctcgtccttgtaaaaaatccctttgccacaagctgatgtcgttgcagccatcgacaagtcaaatagccaatgtcgtctataagctcaccggtactacccttcatcagagtttgtgcatttttcactggatcgcatagagatggaatgctgagctagagcgagaggtggctatagcttmaccctcgatgtgtccatgaggtcgccgccggcgtgaggtggctagatctagtcgttgcaacaccactagatctaaaggttgtgtggccatgaatcgagttagcaagggcgaaacaatatagggtattggtcgcctcaagctcatgggaaggggtgtgtcatttttaccgttgccttgagccatccaaatcttagatacgtgagatcatcttcgtcatttcggtggcctactaccggaacatggttgttgcatatattccatcggcacaatgacatggagccccaccatgcaacacaaggtaggtgttaagaggctgagctgtagacttgcggtgcatgtcttgccagaaagctcaatggagccagtggacttagcatgtgttatttggcggtttcatgaaagcacagcacacacattagcgtgtttagtaaggaaaaaatatacatgtccaactgaaccaattctctagcttgtgttgaggatgtgcatgtgatatgtatgttaagtgttcgactattgtatttgaaagaaaacaacataaccaatgaatcgtgttcctaaacttcccatttgtttgttcttctttagcctttttggcaaacggtggcacaaaatggtttgtgtggattgaaagcattactagtgactggattaatgtactatggtattaaacaaaccactaaagaaaactatcgagttgatatttaactcttaaaagttaaccaaaatgtaggactagttccaaacagcaccaccaaccaataattaaattataaaagaagggagcatatatattaacataatacaaatgttcatccaaaattattcgtttgtctatctagatttgactaaattaagtagttgtttaactagtatatcaggattcattacttgagtggtggtagaaatatactgtgcgcagggaaatcaaaggccataaagaccacgatgtttttggtagcttggaaaatctagagtgaacacaatagacaagtcttcaaccaacaagagagagagagagagagaggaaggtgtctcaaattgttgaaagaaatcaacatttgagttatgtgtagagtgaaagacttagcgagaacatctagcttaacatagccgtgtagtttatgaagactccacagtcatatttttttcttatgtttttgtcgactgtaagtattgtttgtactgaaatattgggcctgttcactttgatgctattttcaaccttaccaaattttggtaaaattaccaaaaaaatatctacatttagtttgctgctaaattttggtaactatataagaaatcctaccaaaattttgacaactatgccaaaatttttggcaatgccaaatttcggtaagttttttttcatcaaagtgaacatgcccattgttactcattcctaatactataggaacagcaatatttagaaaaaaaaacagtcatatttgtttgaaaaacttttttctcagctttgaagaggttactttgagaacaagcatgagaaggccacagctgtcattttcagtctcggcctaaagcccaagaaagaaaaaggcctaaaccccttaggcccttaacgccaccaagagtccaacaccaagccgcaccagatctccctcttcccgaaccccagcgccgccgccgccgccgccgccgatcgcatcgggccgc

SEQ ID NO: 5965 - DNA, 1940 bp, Oryza sativa
ttcgaaatcgtgcattcaacaaagccgattttgctcgggggcaaaatgttaatatgcttctaaggaaattaggagacacgaacgatgataggtacgacctcacatcttgaagtcgccatttgttgggtctaagtgcaaggtgctcggtgagtaattatctagttggaaatatctataccaagttgtgtgaatcgttcgtaagaaattattgatttgttaggatattacaaagagattgatttactaaacacttagaacctcatatggccgataaaaattattgccctaagaccacatgtcctatgcttttcggctcacaagttcgccaaaaaggcaggggtatgtgttaacgcctaaatttgacatctagacacgaaatagaaaaacattgccaaatttgggagaagatcaggtttcctatggaaggccggtctgaccggccacacaccgccgatctgattggcccaatggcaatgatcagatcggctgatgactctgaatccaaattttgtcgggtctcgggtttccttgtttgggcctgaggtttgttttaatcctaaaaatgatctctcatcataataggacgtgggaaaaaccctgtgaggcaagaataacctttttataagggctatggcaagttggattctaaactcccaaccacaacctctaaaattaatcgaatcgttttttttacctttactttgcagcatatcttctacactatcctagtttagtccatctttgttgatttgtgccataaatttttcgccttcactacatgagtgcgatacccctttgtagctttgtcttgtaaaccttctgtttcgcctacgagacgggtggttatcttcaaatcgatcagctctactagctggttaaatcttcaaaatccatcttggtttagagttttctagatcgagatgattggcgactccgttaacaccgcaaatctttaagtgagtctgtgttggtcagaaaaagcgccaacaagtacgacggcagtgcctgcgagggagacatgacggtgatggatgagaaggctgaggcaacagtgcttgcacgttttgggagctgagggacgcgtcatatctgctattgcggattatagattaaattcagactcggtgacaaattaagggacctagagtgaacttattcccaaaaaattcatttcggcccatgagcatgtagtcccaattatcgggccccagccctagctctataggaccgctcctgtccacatcttatcaaaaagttctgtttgttctttttatcttgagacggattaaggtagagaattgataatttttatatctttgtaattcgcgtacttgtaaataaagttacaagaaggagttctaccattttcaacgagaacgataaaataactctggaattgggccgagatacacatactcccctcttttgtagaaaaagtccaattctaaaaatagacaagtgcttgtccagataaattcttagaattaacattttttttaatacaggtaggtttgctcgttgttgtttggaattaacatgccattgttttaatttcacctctccaaaaattgtacttcttatttgatcctccaaatgttcttaaataaaaaggtcattaattgtacttcttatttagttaagctctacaattgattgtgatacatatttgttggcgaacggcttcgtcagactctcgcggcgcgctccacgcgcacgacgcgcaccccgcgcacgacgccgcgctcctctcgcaccactcgcaccgctgcacgtcccttagatcaggggattagttaggcccaggcaactcccaagccttgttgtacatgtataaatataagctccattgatcaatgaaagttacggttgatccaaatctccttctacatggtatcagtgaccctctgatcttagtcttccgctacctctcccttgctagc

SEQ ID NO: 5966 - DNA, 1913 bp, Oryza sativa
gtacccatgccttgcaacaatgtccggccacacacacataaaatggccggccacacacacagaacgagcaagcaagcacgcacgcacgcactcgcacggactacttcatttctgcaacaacttgtaaagggcactactacgctagtgctaccgggattggaatgcttgggccctgtttggaagattaacccagggctaattttgagaaccaatgtttagtcttgaattggtaagctaaatattagtttagggtaatatgtttggatccataggctaattgagggctaaaagatggagagagagtaaagagagaggagagattgagggagatatggctgctttttgatggtccccacaaaaaattagccccattagcattccttggaggggctaatattttgaggggtctaattcactttagccctaaattagcccacatatttagatccttatagggtaatttagagctaaaaggtggaggctaataattagcccatggaaccaaacaggaccttggagccattgaaatctagtgcctagctaggagtactgtagtagtaattggatctcgcaaaaaacctttgtggaagtagtggtcaagatttgcacgccagccaatgcacaaagaacacaacgaaatcactcaccccaacaccaaaacagttgctcaaagaggcacaaagtgacgatgcccttgtagaaaagaaaaggaattctggtactatacgctctatacaggaatcggagccgtacaccatcagcaggcagagagtgattgagtgaacgtccatatgtaagtagtcatgcagattgtgcttttgacagtctctcatgagtcatgtgtgcatgcatgtgggcaacccaaacacattttatactgcttctgctacacaagaatatgcagctctgtgccgtatccagaagccaagattagcacatgaacctccctaaaaattaaccggacgcatccatgcctgcctctgatccgcggatcatgatggaggaccggttggtggctgaccaccagccttccagagattctgttctttcaaacgaaagcacgagctgcatctgcatgcttaagcgaacacctggcccagtagaaaaatgatgtaaacaattggcttttccgatcaccaggtggtggatgcgactgtaggtgcgtgtgaggctacgagagctggagtagcatgcatgctcacgagtccgcatgcagctggctgcaacagtgcaggtttgtgcgagaatggatcgcaacaagctactacaaaccagcagcgctctaatccgttaggattagatcatggtggtgcggaaatgcaattgatctgtgcgcatgtgctgtaacccaagaaatcatactgcttctgaatcaaggtacatcggtgttggaaagattttcagcaaatcatgatgtgtttgctcctcgctatggaggagagactctgcaagtctgcagcttgtttcttcagtttctctctataaaagataaacgaaaaggtttcttcagtcacaacccaatgggatttttggaggtctaatttttcttcgtgcagtgggctcgaatagtataagcccaaatagtaaagcccaagatgttaagaaatggctaattctggggaaaaagtacacggaaggtccctcaacttgtcacaaagatacaaaaatgtcctcgaaccgcaaaaccagatatgcggggtcccttaactatacaaaaccggtcacccgagatcccaggacagtattgacgtcggatttgtcctatgtggcggctgagtcagcgtgtgacccacgtgggtcccacatgtcaggatgccacgtaggacaatctctttcccctcttctctcccttcctctctctctctcactttgctcctcgtctggtggccgatgacagcaatgtggcgcgactt

SEQ ID NO: 5967 - DNA, 1976 bp, Oryza sativa
gggacccatagtcactgggtgtttgtttaaaaatttaaaaatgtagtgggacccacatggccacatgttatcaaccctttctcttctccctcggtgcattagagcaagtttaatagtatagcccactactagctccaatttatatatagccaattcatacaatagttgcttactatactattaatatatggtcccacctgtcatacacacattgtgtcttggagtatgcgctacagctagctacaaatctgtagcccactgctcttctcttttatcatttatctcattaaaatatgtttacagctggctaatagcttgctattgtacttgctcttagagcaaggatagtaacgtagccagcagccggctgaaagccactgccatgtcacttagccatgctttaaaagctcacctgtataatgggttgactataagctgactgatacgttacctaattaaaacatctaagcaattaatatatgcatgtgcaaagcatctgttgtggagcaggcaccggctcaatcgccagcaccgagttgggagcgggcgttttgcctcgggtacgacgcttcgagccggcgactcgcgactcgcccatttccttctctttcttggtttctcgctcctccacgttggatttggatgacgcagcggttgatttcgccagctgactgtacattactatacttgctcttagtttagacttcaggtgtcgccgccttcaccgcatcggcctcgagaacggcacgctaaccccaacgactcaccaatacttaattcttgatcagtttgaactcctgtctcccgctccctaaactccaagaggcacaccacgcattccagtaacctctattcgtatcgtgcgttagcgtgtagtaatccttcgtgagctgctcgttcttgctggtgatgtccacccgtggcggtgaggacgctgaggaagacctacgattgttgttgttggaggtgctcatcatagatgctggaggtagaggacacaggaatggagtgaacgcgacattgacatgctatcgtaggatttggaggaataaagtgtccgggaggccttgctcgtcttgttggaggtttctgctagtgaactcccaccaacccgacatcagctcaccactaatgtgtcctggcgagaaggggagggagaggagggagggagagaaaggggtgatgacatatgggtcgtaccacatttttaatttttttaatggatacttatgtgtatttttttaaatttttatcctcccaagtacgcattgcgtcaacgctgcaccaagttaaacaagccatgtaagtgccacatgagtcaaaactgctctcaatactatcgagggacttggtctacaatggttttagaggtggggatactctgtatctgagtttatggttgagggacacgaataaaattcaacctctacttgagggatgtaaagtggcttttgatatcttaatgggatacaatgccttcaacataacaatgggcttctttgagtctatttaaagcccaaattattgggcccaaatttagtagtagatgagtccaattaaaatcggaaaaagtccactttgagttctttaaaaagtaggccaaatctaattcctacccttcaatcagaaaatcggataggacgactccccgaactattaaaaccagtgcaattttactcctccagcggttttggagggtggttttgctgacgtggtggtgttgacccggttttcgtcccacgtggtgcttatgtggcatcagaactaaaaaaaaaatgtgggacctatttgtcattctcagaaaaataatgtgggacccactgacatgtggggcccacaatgtcatcctttccctctctattccttcttcctcctcccccctccctctccctcccttatctctctcttttatttccccttcggccgtggcggttgcgggcgggatgacgggtgcggctgcaagaggaggggactgc

SEQ ID NO: 5968 - DNA, 1999 bp, Oryza sativa
gtacatgtacctgcatcagaatctagttcttgatagaattagtgcttcgtgctcctcgatcataatcacagatcgagctcactagttcgtactaactggcgtgtggatttgggtcttgaagtggagcactcctgctgacggactgttggacattgaaagggcgtggtatatgaattgattccgagtaaatggattcggaggaccatcgatcattggatggtactcctccataattgctcggtgcttgatgatatggtccttgcacgggagatatactagtacttggtgtctgtgtgcacagccgcacagctataaaaggagaggaggcacctctgcaccctctctctctctctctctctcgcacacacgtcacaccacttcagggttatgctgcataaaaacgtctactgagtactagcagcactatgcagtagttctataatgtttgttctgtgcagtggtttactggtatttacgtgctgtacagctgatagtataatgaactatatatagtgctttagatacttcataacaacgtctactgaagtatatcctagcagcactatgcagtataaagttggctttatgcagctatactggtatatttacgtacagtaaagcacagtagagagtaatgcaggagtatatgataaactagtgcctggtaatgcagttaaggctcgtttgactagcaggggtgttactgcgatttactactatactacgacccttgcaatatggagtatactgagatactctgaacctgaaggcctgcatgtgtaatggcaagcaatttaatgcgttggaaaatgtaacctctgcagaagcaaaaggaggccttggcgatcaaactgaagctgcggccgaggcaggtggaggtctggtttcagaaccgtagggcaaggtaaaaaatcccccatcttgatgcaatatatagagtacccaataataagttcacaagcttctttatttactcatttcagtagaatctactcctcagtcctcgttacactatcatatactagagtattttctccgctataaatagctatgttctgtacataccaaggcaaagacttgtacacgagaatgtgacgaagaagcatacttgatcctatatatgttagccatacatagaagtattagcatttgaaatggttcatgtgacaaaacttcacaaaagacaaaaggcattagagtacagtcaatccggcttatgctaaatgatgatcttgaaagcgaccactatatggcatttctttacaaatttgcattagagcctacgtaaaagctagattgattactacacttattagtgttggtgcaacacaagttatactagcaggaccacaatgaacccatcattccaacaaaattatgcaatcttttccctcacgaaggtgacaaggatccttaggtatccatcttgaaactagtagtgcatccaagatgtgagacaacaaacaattagctagattctctagcctgataaagtgtaggcagttccatcatcacttatgaattgctgctagatggcgtagattactccatgatactcgttcggtttgattccaggattaaaaaaaaccgagttgcttgttccaatggcgccggcacgtggactaatcggcacgtgctacagctctctgtaactttgaccctagctacctaatgcgaaatcttagtttaacacgtcccgtgaaggatggcgtacaacttgtaacctgaacgccaatccatttcaattgatccctacaaaggccattgccttcactctacgtcgccgtcgaggtgacaatgatatcggaatggacgcctaaggtcaaattgagtaactactctagttcatgccgctattttaatctgcaatcaagtagtactgagctactaataatagtaatgtcgcgcagttaacttcggcaagttcatggcagaaacatcttttcatttgttaacgctcaatcgctgcccgattgttactgatcgtaacgtacgtggc

SEQ ID NO: 5969 - DNA, 2007 bp, Oryza sativa
tgatggcaccttcaagtaccagtttccttgaaatgagacattaatcatttgtgcttgtgtgccatttcactttcccaactttagaatttttagcaaggcaccaacccacctaaattatatatttcactcagcgatccaaaaggttggcattcaataacagaatgaaaagaaggaaaggggatatgttacaccaacgtaacactggttcaagaagaagcttatgtgaggcatgagaaatccagagtttcagatggtcatgcatggcaatgttgtccaaagccatgtaattgtgacagttttccaaccatcaaccactatatctacgttgctcttgcctctcaagctgcaataaaccacacaaccagctcactactggcagttcgccaaccctgtggactgtggagtttttattgactatgagggattcaagaaaaaaagttacccaatccagttccagtccaaaaaagtaaacaggaccaacttaatcaatttttaccttacattcaaatgcaaactcagaagatcaacaatgctgaagtacatgttgacagccactaggaaaaaaaagacttcaatgacaaaccatagaagcagagtctcaacgtcaatggggactggttgtaagcaaaaatacccgagacatccactacagtctacacaacaccaccaaacacagccctgcagtctgcagatggaccgagaagcacaccatactgactttgagaatataaataagtttcaattggcaaaagcatcgagaatattgcaaactttaccagtctaaaagaaatattgcaaactttacaacaaaggcagcaagtagcaacaataaacttgaccaaacacagcatatcaaggattttctcttccttttctaaaccgcaggaccaaacaatgatgcaactttccttggagggacactgaaccattacttgctgcattatcatgggtttccacagtgccgtgtgactgcatgagtgagcactgagcaaaagcccacaaaaaagagcggtcgagtgatctccctgtctcccagtccgagatgaccaccagatcagtttcaatgtcatgccaggtcagtcggcatccatgaagactgcactgcactgtgaggccagaagatcaccgtgcaatcactgagaaatcagcttaccactgagtaatcaccgccgcagagatgcattgtaaaacgtaggcctgatcggaatttccccgaacacctagcatgcacgcgtggggttgccggcaccaatgctcagatagcgcaaatcctacaccgagttccagactacaaaaaccctagaagaatcccctaccacagcaaactccctatcgcgacgagccgacgaccggcatcacccaccacgggatatgggaagatcaagcggacgatgcgttcggtgagctcagagaggacaaattaagacgatggcgcaggggaggaaagcgcgtacgtaccagcgcctccggggacccctcgtgcttgcccgagctctgccttcacgccggaaaatataaaaaaggatccgccgccgccgccgacgacgacgacgacgacgacgacgcaaccccgcggcgcgcgccggcaaccgtcgtcgtggccgtcgttgcgcgcgtaatgggctatttgggttgggcccatctcttgatacaaatagtgggccggccggcttgatgaaactgggccgtccatcaccgaacgaacagcccacagaaaccccaaaaaccgaaaatccagagtcgatcgagagcccaaatcgaagtccagatttggcgggaagggcaacgaccggttcccgcgctcctctcctcctcacctctcctttgatcctttccgaactctacgtaggcctttcctcctctgcctctcgtccatccaagagggggaagaacagtttcatcgtctcccgaagctagcagaggcacatattttcagaaaccaagaacacacacttcgcggagagtagtttggatcggatcgggatcgggatcggtgtgtcgaagatg

SEQ ID NO: 5970 - DNA, 952 bp, Oryza sativa
  misc_feature (81)..(81): w = adenine or thymine
  misc_feature (93)..(94): y = cytosine or thymine
  misc_feature (99)..(99): k = guanine or thymine
  misc_feature (154)..(154): k = guanine or thymine
  misc_feature (744)..(744): r = adenine or guanine
gctctagctttagtcccggtttggtaacaccaaccgggactaaagatcgatctttactcccggttatttcacccgggactwaagattgcgaayyttaaktcccgaattggtactcccggtttggaaaccgggactaaaggggggttacgaacckgggactacaaagggtttctccaccagtggtttctatacaaaagttgcttaaaaaaatcaaattaatccatttttgaaaaaaatagctaatacttaattaatcacgcgctaatggatcgctccgttttccatgctactgttccaagttgggaacaacccatagcgaacacagctttactctcatatgagttcttttctcctctttttcttgagaatttctgtctgaagaaatttgcttagtattagtagctcaatgtcattggagaatttgtttattttgaatagaggccaggcaataccaaggatcagcttgtggtacattgaatatatgttttttttagaatgtttcattgaatatatgttgagaacatgtttgttttgtattagaactgttacaatattttttttcataaacttggtcaaacataaacatatttaaataggaaaaaaatcaaagtgacttgtaatatgaaatggagggagcagaaaaatatttacggatttcgctaggatacccacaaatgtaagaaaagataaaaaaataaaggaaaatacaagtggtttacaatgaggtccttaccagattagtaraagcccaaatccatcaaaaattggcccaactacaataataccctgtgtgctaaagcccagcccactactatacaaaaggcctagcccatcaaggccttgctagccagtatccaccctcctccgcttgggccacctgtcagttgggtctcctctcctccgcatccgaatcccaccacaccatcggagaggagagagaagaggaagcaag

SEQ ID NO: 5971 - DNA, 1276 bp, Oryza sativa
  misc_feature (163)..(163): r = adenine or guanine
  misc_feature (165)..(165): r = adenine or guanine
  misc_feature (170)..(170): r = adenine or guanine
  misc_feature (172)..(172): r = adenine or guanine
  misc_feature (253)..(253): r = adenine or guanine
caggccatacagctctatcgcctcagccagccagcaagcaaagcgaaaccggattattattatttctctcccctttctaagctccaatttctactcaaacagtaggatcacctctgcagcttgcttaactaattatctctgatgcaaagctttcaacaaaaargraaaargraaaataatttctggtgcagctaacaccttatcagatacagggaaattaagcagacatctgataaaattgggacgataaacrggacatatacatgggattgacgaagccagattactgtgtatgagtagtcgttacacactgtcaaatccgtgcgctttgttagcatgctatgccagtgatggctgcagctagagctagagcagagctaagtagcagctaagcaccactccatgaggcgagctacgagggcctcacgaacagaaggcaccggcaaggccccttatctgccacgtcggacgggtgtgggccccacgaaaggacaccatggctccctatatagccttcttcagcaccctatccatcctccctgcctcctccttcgcacgtattacgtgcgaaaaaaaaaatcatcagcacaagatcgaggaggctttatctgaacaaggtacacacatccatctccattagcgtcttctattagatcttcaatgatcgtaggtgtatgagtaaattcagtttagccatatggttggattttgtatgtgcaagaagaaattgaaacttagactaagttcagagaaattttgctttgttattgtctagagctagcaacttgaattttcaaaacagagagccagtagccgcatgaattgatttcttctggataagcacgagttaatctgccaagtaggatcagagcacgcactaatagtcgtttctttaattaaaaaaaaggaagaaaggactaatggtttccttggataagtgaaactgtccaaattgataacgtcttctgcgttattagtgacaactagtactagcaagtactcctgcctttgtttttctttcgagatagtagtgtactgttatgtctaactaaagccatgtattaattatatgtttgctatgttatatagtcggataattagagcaaaacaattaacaaaccgtatatagtacaactaagatagtaagatgagattatcactagtcatttttcaaagaacactttcagaaggttatattaggcaggagtttttattgctgtgggacgaataattattttttgtttgggcctgatgggcctttgtgtgtgtgtgtgtg

SEQ ID NO: 5972 - DNA, 2000 bp, Oryza sativa
  misc_feature (840)..(840): r = adenine or guanine
  misc_feature (1000)..(1000): y = cytosine or thymine
  misc_feature (1016)..(1016): y = cytosine or thymine
  misc_feature (1021)..(1021): k = guanine or thymine
  misc_feature (1079)..(1079): y = cytosine or thymine
  misc_feature (1087)..(1087): w = adenine or thymine
  misc_feature (1093)..(1093): y = cytosine or thymine
  misc_feature (1114)..(1114): k = guanine or thymine
  misc_feature (1119)..(1119): m = adenine or cytosine
taatcatatgttctcgccctgagtccttgctttcaatctgtaactgcaggtggttgactccaacaaaactgcaggggcttccaagcaaacattatctgctgaagatatggaggatcaacttgaacagtttaccagcttgatgcaacagaagttcctgtccggtgaagactctgagcatatggactactctcggatcgataacgacgagatgctggatgaccattggtcaaaagaagccaactatgatgcggaggagaagtatttcgaagaggattagttcaaagttcaaactaggctgctgttatagcatcagttatgtagtgcatcatcgcatctcgttttttttttgttcatgttcagcacttacttagtctatcatgtacatatatctatatatgcagttgttgcccctctaatccgaataagttgagtaacttgcttatgaaaactaccgtatgtgttggaacatcaatcagaaaatagggtcctgtcttgtggagatgtttacaaattgcaaaatatttttatgcactacctccaggatgatggtgcatgcagggaaagtaacatgtgtgtattctatatttctaggggattacttgttcagtctgaaactgtgaaccgcatgagggaagtttccttcaaagcgaagaatgtatatatgggaaggcttagttagaagcagcgtgatccaaccagggtttgctttggttggacgaattggtcttcagacacttcaacgcaagctttagtattttttttttctcttttggttttgtattaagcccctgcctcgtgtgctgttctgatgcacgctttctttgtaccaaaaaaaatggrgacaaatgacttattcctgaagtttttgtgaaagcttttgccgtgtcttgcctgttccattgtttttcttttcttttgctgtgtttgtgctagtgtattgcctaccttcttctttttattaattttctttcttttgcattagtgccttgactaccttccycttttctttccttttyctttkgttatcggttaccacagtgtcttgcctgtttggtgcaagccgagaggcaaaaccaccycggttaawaaagtyttaagagaaagggactaccakggtcmccgtttttacgggccaaccggccaagaaaacttaaaagtttttgagaaaggacgatgtacatatacccctattaatgtgtatagtagatttctttcagaacatttaatccgtttgcagatagtgcaatttttattgttttgatatcccccattagatgaatatcttaaaacacatattctataacaattgaagaaaaaaaaggaaatacatttcttttttcaggaatagatagatattcaagaacaaattaaaaaagaaatacatttttcaggaatagatagacatttatgtaccagagggataaccaaactattccctctaaaaaagttagtttttactctgtcatttttctttaaaaaaatagctttgctcatttttaccctgcttcaaagaaaaaaaaacaattatagcatgcttgtactgtgaggagcagaggccaacgccgtcggtttgctgaatcagcaaaagccgaccaccgaccccacgttccgcacgcacgaaacgaaagtacgaaacccgcgccaacacaacccaaccaatcgtttaccgccacgtgcacgccaccccccaaccaaaacaaaaaccaaatttaaaaaatactacaatataaatactagtataataatttcttctcccataaagcttcgaccgaatccggctcgcctcctattaatccctctctctcctctccttttttcgatttgagaaaaaaaaaatttgctcgccttctccttccctcgcggcgaagacaccggagccaccactcgccgcccgcctatttcacgccgccgcgccgcgcagaccgacctcgtcctccaccccacccatctccgacgccgcggaccccggcggccgctcctcctttgctccattcatcgcc

SEQ ID NO: 5973 - DNA, 1998 bp, Oryza sativa
  misc_feature (1016)..(1016): n = any nucleotide
  misc_feature (1027)..(1027): n = any nucleotide
  misc_feature (1034)..(1034): n = any nucleotide
  misc_feature (1055)..(1055): n = any nucleotide
atctcacatttctcttctaatataacggtgtgtaaaagtgtgcaaaaaatatatcccatattgctcaaatgcattagtcagatttaaaccatgtgagatatctaagttttgaatgtctattacttttgaatcataaattgtatttttcatctatttgtatctttttttaataattaaatgttgactacccccgtgaaatctcatcgtatttctatttttttagtgtgacgtatatatacggtagtcataattttctatgatgaattacgtcacctatgattagtcgattacgtttgctatcaaataatacattaattattgattttttacacaaattggtagagaaattagttacatatggttgtatatccaatatcttttatagcaaagttttctctcttttccgatagaacttcaagagtcagatgtcataggtagcataaaacccaatctcaagtaggtaattttataaatggcataattaaattcgtcatgcaatgttaacggagagaacatagacaaatcgtacttttgaaatgtggcaggtattatttcataagtatacaactaagtttctcaaatgcaacctatgatacatgcatgcgcgcctagttatccttaaatgtgaagttgtagttttatttttttttcaagtcaaagatcacagttaccgtggcttaccgttcgtgcagtaacatgactttaccatgggatttgaaaattcttaatccaaactttcctaaagataaaattcgtatggtttttgacggtcactgcacaattatcacgtttaccgtcgtcttaccatcgaggagttgtaacctccccggtgatggtttgggaaaccttgctcataggcattatagccgtatacaagtttatttcctaactttattggaagataaatttgcataggcacatatacttcttcagtttcaaaattcgctttgatatgcccttattgaacatatgggatatatggaagttaaatacccttccattacctgggcagtgcnttgatttgtcngtttacncgttatggtaggtaattaacngaatacgttcggttggcaccgattaaataaactttcatgcaacaactccaaatatgatatcccacgtcacatccatatgctcgcatagcgtgcagtttatttaacgataggaaatatacaatatcaaggtgttaaaaataaaatggaaacaattcaattaactattgtcaggtactattagaccatatgacgtcgtgggagtaagctactaggttatagcacacgttctattaaaaatatatgttgcccaataacatcaaagataatttaagtaaaaaaaccatagtagagagaacatgaagtggtaaaaaaaccattgtcacgggttttggttagtcatatttgattactcgtaaatatttttactaaaataaaagtgattgagtttgaatgtaagcaacttctaacgatagtgcattctaaagtgctaatggacaatgaattatggccagaattgagttcacgacaatttcgaggttttgataaattgatttaaaacgctttataagaagtgtcaatgaaaaaaaagctttcgtaaaatcgtgctgtgataaattaggaagcttttcgaggcggaagcggataagttaaataaaaaagtcaataaattaatttaaagacgttttctaaagtaatgacacgaaaaaggattatataaaaaacgtgccgtgacaagtttagaaaacatgccgtgataaatttaaactagaaaggtagccacggagggagtactctccttcagccagataaaacgtgacgatatataaacggagtgagtagattaacttagttagctctcaccaagtgttatgttaaaaaaagaaaattaaatacaattacaactgtgaacttgacgagtgacacatttaatcaacggtgtgtacggtaacttgttacaatcataccgaaaacccctcatctagccacacggaatagcccacac

SEQ ID NO: 5974 - DNA, 733 bp, Oryza sativa
gcaggtcaatgaacgctgcacataaacaacaataaatgggtcgctgctgcgatcggaggtagacgtgacaaggagagccgcatcttccatatccaggagaagagaaaagatttgataaatcgaagaagaaaaaatttttggggaaaattttatcctggggacgcttggattgtgtgctggttgcctccgatggtcgcaagggccagaaatctcgtccacccaaaccgcggggagccctatcccctcagcaaaagccaagatgctgctgttcccgcccgccactaaaaatatttatgcacctcctcgcattaaaaattccatcgacgtcgcctcctctcctcctcctcctcgtcgctgcattccggtgagtccgtgcaatgcctgcattttgtgttttcgtgctcggtttcgtctcgtttttgctgatgacaatgttgtttgtttgatgcaggttgagtgagttggtgattatctgtagggggtgaaaatggcgcaggcggtggtgccggcgatgcagtgccaggtcggggccgtgcgggcgaggccggcggcggctgcggcggcggcgggggggagggtgtggggagtcaggaggaccgggcgcggcacgtcggggttcagggtgatggccgtgagcacggagaccaccggggtggtgacgcggatggagcagctgctcaacatggacaccacccctttcaccgacaagatcatcgccgagtacatctggtac

SEQ ID NO: 5975 - DNA, 2099 bp, Oryza sativa
  misc_feature (829)..(829): s = guanine or cytosine
  misc_feature (1819)..(1819): k = guanine or thymine
  misc_feature (1823)..(1823): r = adenine or guanine
gctagtatcgtcgtatggtgcaggaagctagcggccaaccaaagtgctagtgtactatactgttttgactgcttgcctcgacaaatctttctgaatgagcatgacaaatactgttacttttttttaagggcaagatgctagttaaacttcagtcttctcttcaggaaaacttcagagaatcttcatattagaagagcagtgatcagtgcatgcttgtggagaactaactggccatgtagggcagaaaaggtgcgtttattaagaactcatcactatgaattgttaatttcaagaacattcagaacttgtggtgtgctgggtatgtatatgagatccggaggttgagtggacagtgcaccttctcggtacaatgatactgaattcacggaataatgtggaaccgcaagtccgcaactctgcaagcttacaagtagaacttcttggcaagttgaaagttactagtacgtacagatttgcggtatagagccttgaagaaaccaaaaaaagcgaaagaaagaaaagaaaaagggagaaaagaagaagcgaaagcgaaagagagacgttgatcaggtccaggcgtccagcccagcaccgaaggctctccgcagctagatctgggcccatttgctacggcgaaaaaagacagggatgtgatcttgctagctttcgccaaagaaagctaccacgtgcattgctgcccattttactcgccgctttggacgctttcaccgtgcttctctgcaggctgcgatgattggctgcagcggtgcgatctgcctgcatgtataatctcgccttgaccagatcccaatcctccctgctgatgttsccggagcaagcgatccaaatctcctctcccaggcttttcccaaagaaaggtgaaaggatgcaaagcgaccgaccgccatgagcgacctcgcgactccttgctctctgatcaagaagttcgaagcctcaaaaagagaagaggaagggctcgtgggcttctggcgatgtcaacttggggtacgttacgttctattcctgacaagcgacaacggcatgatgggccggctgaacacactggcccggggcccatcagaagtattcacgatctgcgctggtgacgtggcaccggccggatttgcagctttgaataatttttttggaaagtggaaaaataaaagagggaaatcatcactccgcgtccagaccgcgtccggggtagtacggtaatctccggcctcctggaaaactgacacggagccggtccctcttttggaagtcatgggcaggttgactgtaccacatggcagcacgttcccgcaattcacaggccttgtccctcgacgttgcaccgtgtgaccaaaatgtcctcgcatgttgccctgtgtcctacttgctcggtgctcggtataatgatgccatccatgcacgtcatacatatatagaacttatacaagtccagataaaacataacaccgcggagaaaaaaaacgctagtaagagccaaatcatgatggattgatggggtgcacatgtatatacataccttcagacggaaagaagatattcatgcactacaaatgttacaaaatcacatcctaacatagtaccaacgacgctgacaacaccaccgcgcgagccagcgacggactcgcgcgcgtcgtcgtggactcgtggcgcccatgtcgcgtcgcggtcggtgaccgctttgcccgtcgcacgttgcgagcatcgcaacgcgtcctccactccagcctgtgccaacgagacgagggacgttaggaaagtacagccgcgcatatcttggttgattgatcaggaggagacgggggaktgaragggagagagaggaattgaagggggggtagtttggggaattcgcgggggcgcgacgttaacgggaggcgtggacggcggaacgggccggtcggggaacgggcgggcgggtataaaggccggcgaaatttcccggacgcgaggccacagatcgctcccagccattctctccgcgacggtctcgtcttccccacccctcgcctcctcgcgcgctcggtgagagaagcgaagaagaagaagaagaggaggaggaagaacgccaggctaagcccagcggc

SEQ ID NO: 5976 - DNA, 1998 bp, Oryza sativa
  misc_feature (321)..(321): n = any nucleotide
  misc_feature (329)..(330): n = any nucleotide
  misc_feature (345)..(345): n = any nucleotide
  misc_feature (349)..(349): n = any nucleotide
  misc_feature (370)..(370): n = any nucleotide
  misc_feature (444)..(444): n = any nucleotide
  misc_feature (449)..(449): n = any nucleotide
  misc_feature (451)..(452): n = any nucleotide
  misc_feature (461)..(461): n = any nucleotide
  misc_feature (466)..(466): n = any nucleotide
  misc_feature (494)..(494): n = any nucleotide
  misc_feature (496)..(496): n = any nucleotide
  misc_feature (509)..(509): n = any nucleotide
  misc_feature (515)..(515): n = any nucleotide
  misc_feature (517)..(517): s = guanine or cytosine
  misc_feature (526)..(526): n = any nucleotide
  misc_feature (528)..(528): n = any nucleotide
cacgcggaccgaccgcggattggcccgatccagcagttaccacccaaatcccgtgcgttctcccgtgcgaaaagcacttgcgcggtacacttgtcggccgctgcacccggccagatgccccttcggtcccggccccggcggtagcagtcgttggactggacggatgcgttatcaatgtggacggcagcgggacgagcgtgcgacctgctcggtgccggtgcgtgagggcgcttcatcaatgtggcaaaaacggagaaatcaacgatatcaccgacgtagccgtccggccgaggccacgtgtgctgccccggtttcgcgacncgtggccnncctccgacgcatgcncggntgtaaataatgggaacgtccntcgcgccgctttccggccggcgctgcgtgagttgatgacgacggcgtcggggtggccgagcacggtggacgcgnacgcnannatggccacnaaggntcgccgcgcgcacgggatccgagccccnantcacccagtgatncgtggncscgggggccncnactgaacagcgtggttccgctggccgggatccaatgcggccgcgctcggggccctgggcccgcatgtcactagccggcagctctgcacctcgccgtgtcgccgtcacgtatagctcatggggttccttaccgaatctatttttatagtctcgcttgcagcatgcaccatctgatatcagccgcacgatctggatatggacgttgcttgttttgtttacctgtccttaaaaatttaggatttgcacaattgcactccatggacagtttgtaacatgggaagaaactatcaacaaaacaaaagggttcaaattctatccaccgatttacttgtatatacgactaattattttttaatgataggtgacatacacatctatagcgagacgtttatggtagtaactttatcaatatcaaaatatgttgatctagtctatcgaatgtattcataaagatagaatgtctattcatataaactaatgtgcgcttgttgtgtttataatatatttaataaacaaaaggattcatatgagaatttgaaatagaattgtttttggtgtacaattgtatcgcccaatctacacatgatgcattatattttttcccctccatacaatatagcagcctcatcggttgctcacatttttaataagccattttgatattttttaatttatagaaaacaaattatatatgtgttcttgatacttaaaagtcaatgtaaaaaaactaattgaaaatatcctaaaatcaacttaaaaattaagtttaaaaatttaatttttggtttttattttggtttattaggtaaccgatggggctataggtttttaacccactagtaaataacagatatgtaaaagcttcaaactttttcatagcttatcagttgtactaagctgaaatgatcaaagctgcctcttttatattaaaaaaatgtacggtctacctaattaatttgtagcacaagaaaactgaacatatctttttcgttgtcgatggatggtctgcctaatttcaatttgtctcccaaactacctcaccttctgcaaggtactcttccggagtccagtagtggaggttttacggctaatcctggctataaaacctcccgagaaccgtcgaagcttgaacccccgttccccaattcggcagaatacgagacctttttctcaggaacacgctgtcacctcacctccacgctcccctcccgcggcagctgaacagagacgagctcaccccacagtcccccactacccccacccaccaccacctccagcttttgtcctgacaccagctaacagttaaaccggttgctgttattagtacgcgccaccacgacgcccacgcacatcatccctccgcgcaaaagcctatcaacagctaagccaaacagggtcaggagccggagccgtccgggagagggaacactcgagcgatccgtccgtccgcccgcccgtcgtcgtcgcgcgc

SEQ ID NO: 5977 - DNA, 1959 bp, Oryza sativa
  misc_feature (1778)..(1778): r = adenine or guanine
caagggggttacctgtccacttcacttcaccataagctgcaaaatgcaatggctgcaattgcatcactacgtcttacaaacgtacttattgcgttctgaaataattggcacttatactattcaagtttattttttcttttttctataaaatttataaatgttgaaaatatgttattctatcaaagtgtgtaatatcataaattcaacacggctgtaatcaacggtgtcggttattcgatattggagggggtattcttgtagttttttttttagataatgagttcgcaaacatgcattgcttgagatggagataatcatgagatggtgaattggtgatgactgatgactggtgatttgggtttatgttttcttaaaagaaaaattggataaccacctcagccacttcaactgctagctaagctagacaatagacagatgtagagatggatagatgtgtagccatagatagcttcttaaagctccaacacacttatacctgcaacaagaaaagagcacaaattacttgcaagtgagctaaagtccggtagctagctagctagataccaacacacacatttgctgccgtagcttactagattatggtggtgttcaacgagattagtgtggtgttggttgggaactacctttctcaggattagagagccatcatttttgttctgtgattccaggtcagtgagcagttaagcattaattgaaaaaaaaagaagagttggacattgacagtttgacacattgttgttattattatctaatgactcctgcagaaatagagcacactgcacccattccggaaaatctcatggtacctttgtcattaatcatgctgagcacagcacacatggctgcactgattgccctgtgaaaattcctactcctggctactacccctgctcctgatccaatcaagacgatgattaaatcagatcaaagtttgtgcttttccagcaaaaacacagctactgcaaagatagatttcaaagccatttatctgaaaagttgcaaagaaaaaggggtacaagtgccatgaactagttcatgatgggccagcagcagtggatatcatgagaaatagatggcgctctcaaaattgcaaatcaatcaagtgccatttttaagcaacacgtcaaactgtgcaatgagtaatctgcaggccaaacaagctcatttgctctagatgaactcccaatgcaaattaccaacacaacaacaggcaaacacaaatttcagaatccaagattattccactaatccataaaataatgcaccactgaacctcacattttgcaaagaatttagtactcactaattctagtatattaaaactcctaattaagttatcctgactccattggaaagagtgaaaagcacatcaaaaacctcagcgaacaaaaagaaacaaaaggcaaacgcatcattttagtggagccccaccttcacgggctcgctggccggttcacccacatcctcagccgtccatcacccccacgtcggacggccagatctcccgccacgtttcacccccgccgagacgtgcgtgtctcttacaggtgggtcccacgtaagttttccctccacgaagtgccctaaaaaaatatataaccccagcgaaaaattttcgcgctcacgcacgcacacacgcggcgcacatgggccgcattgattgcggcacggcccgggctgacccacacgcccactgacgtgacggccccacctagaggtggccccacacgtcatactcttggagcgggtttgggtaragctccacgtcgcggtgggctttactccaaaccccccgcctctaaaaggaggaggagtttagtagtaacctctttcttcttccatccatcgccgccgccgccgccgccgcattcgccgccgtcgagtcgtcgtcgtcgccggtcaccgccgccattggcgagaagcggagaaggggaaggg

SEQ ID NO: 5978 - DNA, 1946 bp, Oryza sativa
  misc_feature (380)..(380): k = guanine or thymine
  misc_feature (382)..(382): w = adenine or thymine
  misc_feature (394)..(394): k = guanine or thymine
  misc_feature (423)..(423): r = adenine or guanine
  misc_feature (427)..(427): k = guanine or thymine
  misc_feature (475)..(475): r = adenine or guanine
  misc_feature (506)..(506): k = guanine or thymine
  misc_feature (527)..(527): w = adenine or thymine
  misc_feature (584)..(584): r = adenine or guanine
tggttctatagggagcccctttacctgtttttagagatttttgctgttaaatgatgcctatggcgacaaaattcttatttttctcttatgttactagagaattttttttcatgttccgaataacaaagctgaaattgagatttcctagctacagcaattacatgtccagctacatcattctgaatataaatctgacctggaaggatgcgttaatgtgttactgtctgtcatataacttatctgtaactttttctacttcatttccatctgcagttgtgtaaagaaaactacaaatacaatctccatgttaagtagccttgtgttctctaaggagaaaatataatttttcttatgctgtactttatacactaatcttctgkawtttagctgcttktgaggctgaaatttgatatgcaatttcgrtaakcaaatcttcggtgaatgaagaaagtaaggtttttatgatggatcaaarggatactgacatggtagattctcctgaggtktctgctactgataataaaacwttgcctgactgggcaaaatcactggagcctgtgagaaaattaccaacaaatgtgggracacgaattagaaaatgcgtttatgaatctttggagagaaaacctccggaatgggcaaggaaaattttggagcattcaatcagtaaagaggtctacaagggtaatgcatctggaccaactaaggttagtgtgctcccctgcaactatggctcaatcttctgcaaaataatgattttcacatactgctttatgttaagagtatttaaagcatggtctcatattagtttaggtttattaccatgtgtttttctgcttatattaggacttgggagtcctcatgtaccctatatgtttggctcttgccaagttggcatacaacattaattcatctgttgagttcctgtcatacatcatgtaatacatattgcatgatagttccgtatctccccaatagtttgtgcttttactatgtctattgtattccctaaaaaagatgtgatgaaaaaagggagccccatgagaacaatcactgtgacctttgattttgatgagaggctttggtggtccaatgagttttttatgtttatctagttggttagtcaaggtttaatagctcttgtagctgtaggtcatacgttttaactttcttaatttcagctcacatgccttccctcatgactgtgtcggattttctgctgatgtgatgatgcttgatgcttccatggcttagtttagctggaaaaatgttgacattagctctgtgttgaaattgcatttctactaatatgctccctccgtctcacaatattgctacttctccgcctacctctcaaccaatcacaaccttttcccattaattttttacctactttctcatctcaacttatcacaaccattcctcacccctaccttaatctcataaaaaaaaagggcataagtagttgtattttgagatggagggagtagtgtatatgccaaaaagtgatctaatggcaaggccatgcttaaacatcattcaaaagaaatggatctggcattagattaaatttgatgtccatgctgatattttgtgtttcttttgttcttaagaagttcctatccctatgcctaaaatattgtttggttgcatacctttttttttggttacagaaagcagttcgatctgtgttgacagaagcatgtcgtgtaaaagtaccacataatccagaaaagccaagaaaagagagaaatgctatttccatctcagaggctatcttgaagaagtgccgtattgccctgcgctctgctatttcctcagatgaatccaaacttttggggaatttgctcggaactactctagtgaattccaatgaaaatgaggatgaaggcatactaggattccctgggtatggtgtccgccctttggactccgcacaattgata

SEQ ID NO: 5979 - DNA, 1908 bp, Oryza sativa
  misc_feature (64)..(64): r = adenine or guanine
  misc_feature (1370)..(1370): y = cytosine or thymine
  misc_feature (1371)..(1371): k = guanine or thymine
  misc_feature (1372)..(1372): w = adenine or thymine
  misc_feature (1379)..(1379): y = cytosine or thymine
agacaaggggaataatggcgagaggaaggaagcaaatctcttcctcggcgactttatacccttrccaacgctgtgcccggctcctcgtttctcgcgcccactatcttgccccctcgtttctcgcgcccacgcttccactaatcccattcgcccgtttgcggtgcatgaggtggatatgcggctgtggcagtcgagatggaacatctcgtgcgcgcgttaattacgctcgccgaccgaagcgccatcaccatatctccaggaaaaacgaaccggcttgtcccgatttttagaccggccccacctgtcaccaggccttaggaagtggcgtcacgcccgaccgcttccctcgaggagggcgatcgccctggcataacgccgggggctactgtcggtgacatgggaccgggagtatcatgacttagagacttgaggcagacacgatcacccacgtggcctaaccccctcgggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcagggctcacctaaccacatttattgcggtttggacgagcgcgtcacgccgcatgtaacgcagtgcagcgcgctcgtttatccggtctgtgaccagtcacagaccgatcagatcgtgggttaggtggcgacaggcggtctgacgcacgcctcgccccatcccatcaggatgagagcctccaagcactcgtccctagccggagccggcgtgttagctcctggagatggcacgttggtcccggtcagatatataccaggcttcatcctaaccattacaagcaagacattgtatgaagaggggcgaacatgcagattgataaactgacgcgtggtggacaagaatgaccgatttgtgaccggtctgacactggtcatgtcgtcagcagacaaccatgttcccacgtcgcgcctgcttccggcggaagtggaggtaggtatgggccgtcccatcagaaggtcattcggacgacaaccatacaagtctccgtctgtttatgaaaagagaggataagtccccacaaaaaaaaaagagagagatggtgcatgtggtatccccttgaggtataaaaggaggaccttgcccacttagaagggggattgattttttcggatacagaacgatcagagagggagagagtaagagctctctggttctccagctcttttgtagcttcttcatacatagatccaccaaaacacaggagtagggtattacgcttctcagcggcccgaacctgtatacatcgcccgtgtcttgtgykwtttccaytctcgcgaaccttccacacacagactaggagcttagaatctcacccagggcccccggccgaaccggcaaaggggagcctgcgtggtctcccgatgaggagccccacgctccgtcagatgtgatagaaaagttgtgtctatataaaaggcttggtgtgatggaaagttggaagtttggaaaaaaactttggaactaaacaaggccttattcttcaaacttccaacttttccattacatcaaaacttccatacacacataaacttctaaatttttcttcacattattccaatttcaaccaaacttacaattttgacacgatcaacccaaactatgaaccgcgcactttacttaaagtaaaaagaaaaaaactgtgcgctctccaactaccgcagcaacgtgtcgagcacaggaacacgtgtcacttcagttcttccaattgctggggcccaccactgtttacttctgtacaggcaggtggccatgctgatgacactccacactcctcgactttcgtagcagcaagccacgc

SEQ ID NO: 5980 - DNA, 2000 bp, Oryza sativa
ttttgatctgttgccatgcatcttcatggagttcagtgatgaaacttgacagtattgcttttcgtctagttatgtagaatcagcctatgagaatactaggatgtagcttcaaggcatgttttggttgattttctggggaattttaccctaattaattcctgcaaaaatttctattccaaacgtgcacttggcttccggtcacaataaccccacttatgtttttttccccctaatatatcttaaccaagagttcctgtcacgtcaaaatattttacaatatagtctaaaataaattaaaaatatttttttctataaaatgtgttacacatccttttttctttttgccttaatttgatgattttatatgttttcatatttgatttgattgtttttaatattaagaaatctataagaagtacaaatgtttcttttatatggcctagcaccgaatattcccaaatttccaatttccatcagcttccatagcggattggaataagttcgtttgttgttcctcatctttacatcgagtttatttggcatccctaaattgcaatactatactcttcactcttttatctttgcaagaccgttcaagtcaagttctaagataatatagatgtctgttttggctgatgtggcctcacatgtaagttgactcctcacctcttccctctcttccccatctctcttcctctcccctctcttccctcgcagcttgccggcggagagagggctggcagccgacgagcccatctgcatgaggtaccagtggaccacctcccacgaaccaccagtgcccgctcttctcctccgccatcacctgcatgtccagcatgcttaggtcgttcagcgtcgccacggtgtcgatcttgccatcttgggcaggcatgacatgctttgtgagtgcgccatggcggtggaggcctcccatcaccgccctgctcgtgtgccccatccttcatggtcgagggcttgccacgccgaggtaccaatcttcgtcgccgatagaggcatggggtttgttcagattgatgtcatttcaaaccatacaatttttttttgatagagttgttagatatgtgcatccatttagtttcttgtcaaactttggtaaatacacaagaaaacctacaaaaaatttgacaatattgccaaattaccaaaaattgataaggtttattttggctacaatctaaacaaccccatcgagccaaaggcaccggggcacgttgcgtggtgggtgatcgtccagaacttgagcggtcactcctccaacctcatgatgtagaacctgcaaagtagaggagagaggagatcaaaggaagtaggaatatttcgccaaatcaagtactagaattagagatgcagagggcatatactactcccttgacgttgttgatttttaatcaacgttgatcattcgtcttattcaatatttttaagaaaatataaaaatatttaagtcatccttaaagaatattcaatgataaatcaactcacaataaaataagtaataattacattttctttaataagacgaatggtcaaatgtatctcaaaaggtcaatggtatcatacataacctatgaaaaccttagaatcattttttttctgactacgatgcctcctgctgccttatgatctggtttgaatggttttgcaaaaatcatttattgtactgcagtttaggaatgccaactgaaaatcgacgtaaagctgagggacagcaagtggacttattcctagcggatcacagattattgaaggcccgtgacttccccgagaaaaggcccagcagcaacttagtcaagggccactacggcctcgccggcttctaggttcgtgtagatgcttctagaaccacaggatcccttaaatactctccctcctcttccatctcgcgtcctcttggaaacccctccaaaccctagccgcctctcgtttcttctcgtcctctccacgcccccgagatctcaggagcacaggaggaggaagcc

SEQ ID NO: 5981 - DNA, 1949 bp, Oryza sativa
tttatctcggcgggtacaccatctcttcattccgtattccttgtcgagatctagcaaccgttctcgagcgattgagaaggcgtagagtctacgacggagctttgtcaacatttgtcgtactcgccttagtcgatcttggtgtagaaccatagagacatgaagttttcgacaatgtcgaatagaattttcttgaaatcaatactcagaaaagaatattagatagaaatagccctcgagcgaatgctcaaagggtgacatgttataatatgacagactagtgaattgaatgtacagaccagtgttttgtatatgagcgtcttctctcttaccgactccgatcagtcagtttgtagagttatacactctccctagctcccagccttatcgtcggagaatcgttctcggatgacagggctcttggacctttgacctgccttggttgaacaagcactgatcctagcccccagccgtgaagttagaaaactcaatttccgattacacggcttggttaatacgcacggcgagaactcttacacgaccagatcttacatggtctttcgtctctgaaggatccgacaaggccttattggctctgggcgtccccagccgaagttccctcaggttcctcggaggccttgtcaagacggcgtaaagggacagtaggataggtttcaacgctaggtgtcttttgtggtaagggatctctgggtaaaacacttggcaatcttgtgcacctgatatcaactttgttgaagcaggggtaatgggagaatcgctacatcgctggtcgaggaccaggcagtagtcgtaactcgaccacttaaagtggaagtagtgggagaaacgccacatcgctggtcgaggaccagacagtagtcgtgactcgaccacttaaagtgaggcgagagagatcactacgttttactggttcgggaaccagaagtaggagtcttttaatcacctataggggcgctaaagttagtttattacatgtgcatatcatgtggccagcatgactcacatacctaacttatagcatatccggatgtccgctcgcaatcatgtcgggtgatcaaaccgacggcgtttacgaggaattatccgttaacaaccttttctcgagtagtccagctatggccggtgctatgagataggtcgtcggtcttcgttggtaagttgggtgcgacgactccgcatttgtcgagaatgttctcgatagtggggtgtactcgaccacaacctactcgagtgctcaaatgtttctgaaaaatattttctagaaggcaagacatatagcagagaatatcgagtatgtactcaaaaactgcatggatcttctagtattattaggatataacgagcagatgtaaatatcaggtattatgtaaaccgtaaacaagcatgacttatacagaagaagacagagcgagcccccagcgttagatcgtagtcgatttaacatcggggacacccgcacaacaggtattattgtataaaaagcatgctctgggtaaacataataaattatggatctgacaatactgtatgatctgaataggtacgataaattgcagataaaatattgcgtacctttatagatacatgccggatgtatctacgaaattagtagatcaatttaaaaaaccaatctaccaattaccttgctgcgtactcgttcgatatcaggcaatctgacatcttttgttacgccgcggagcttgaggcttggatgatctcgatagaccaagttgtcgatgacgatgatggttccgatctagtcggaagatgtacttggacaggttggatctccccacagccgaagtcgtcgagtagcttgttgtcggagagtccatctcttaaacccatctcgtcgaaatcctgaagcaccaaaatccccctacctggcgcgccactgtcgacatttgatgtcgcaattctggtatttgcat

SEQ ID NO: 5982 - DNA, 1949 bp, Oryza sativa
  misc_feature (942)..(942): r = adenine or guanine
  misc_feature (972)..(972): w = adenine or thymine
acgatagaccattggggctcctttcttttttgtttcttttttttggacggattttttttcttgatgaatctttttctttctccacaaagccgagcgtgggaatctgaagatggtttggcaaaatgatcatgtcttggcgtcgttttttccctcaaataatatagacttatttgctaagggaaaggcaccacgtggcccgatcaaagcttgcaagcaatgttggcattagaatataagataggtgcaccagttgacgcgtctgctactggtggttttataaaccgtgaaatatccattttatgtgaacctgtagtatttgtttctttctatgctacaaactcaatcaattgccaagtaatatatcttgattgttaatttcaggtattataccatccatcattacctatctggctatcttatgtatctctatcgtcaaagtgaaccgaataaagttggtcggttaaattctaagctactgaaaaaacaaatttatcatgtaggcatgtcaaacaatcaactggcaaatgtttttcctcatttactgattaggacacacactgaacatgtcacgaaggtcacataggagatactcttatcttgcagtcacaagagttatatggtctcaaccccgatatcccgtatttaatctccaacacgcttataatcccttcaaatcttatgtttttttttacagaaggcaccatgctttgaaattaggtcgggaggacttcaaatggaattcttaaatactattatattgtgatataagtgaatttgctgcttcttattggtagagtgggaaatccatatgcatttcagaagaaggctaagcgtgtgatgatagggaatcaacagttgaaagcttgcttatttatgttcagaaatttcacatgcttctccttccctgatgtataaaattactgctatagccaagccaaaaargaaaaaaagccttgcgcagtcaaaattttwattggggcttacgggcatgtatggctgcttgcagccttggaccattgggctacacgccgagaccaaggagcagatgccgcgaaaattatggcacgtggctaaccttgaaatttcacgcgcaaggtttacatcctcgaaccgcgccgcgccacgtggcaggggccgttcaccttttgttatacactaaactgcagtgtggcggtagggtctagccattttgctcttgttagtttgtggagtattgcactagtgttataagattgtctcttctagataatgattattgtaagaatggtacagcttaagacttttgctccacaagggctttgcccttttgattgaagaaaatatcacccacagtatcccagccaaaagaagttacaacacaaattcccgatcacatgaatgttaaagcaatacaaataatcagaccgaactatttatatgtatatatattgaaattaaactggaaaccaatgaaagaatccaataaatcctacaactattcacatacataacttcaaaggcatttaatgagtgtatctctagtcataaattttcacatctatctcaagtcaatcaaagaaccaaaataatatacataggcataatgttcagatcagaattaaattcccaagatacacaacaaatcaacctatatcagtctatatctactcataaatgtgcagaaataaattcgaaagatatacacaaatcatatccattaattattgaagataaatatgttggtaaagaactataaataggacaagaaccaagttcatcagacacaaagcttccccttgcatacaacctttgacacattcgtcatggatatgcacactctcctattgtctttcctctttgtttccatccttcatattcacacaactagttccaccggtactgaaaatttcgatgcatctaggctagacacatatatagtgcgtgtgcgtccaccaccaaacttctcaatt

SEQ ID NO: 5983 - DNA, 1994 bp, Oryza sativa
  misc_feature (462)..(462): m = adenine or cytosine
  misc_feature (1071)..(1071): y = cytosine or thymine
  misc_feature (1081)..(1081): y = cytosine or thymine
  misc_feature (1083)..(1083): y = cytosine or thymine
  misc_feature (1089)..(1089): k = guanine or thymine
  misc_feature (1094)..(1094): m = adenine or cytosine
  misc_feature (1100)..(1100): r = adenine or guanine
  misc_feature (1101)..(1101): m = adenine or cytosine
  misc_feature (1104)..(1105): w = adenine or thymine
  misc_feature (1109)..(1110): k = guanine or thymine
  misc_feature (1112)..(1112): r = adenine or guanine
  misc_feature (1113)..(1113): w = adenine or thymine
  misc_feature (1116)..(1116): r = adenine or guanine
caatgtgttgtaccgttgttaagtggagactaatcttttcttaattaatcaaatattttactatttttaactacaaatatttacaattgtctttatccaaaagagtagatcatgatacaaaagactactatctttgtttccccttgcacaattacatcattggtgttgcttgctgagtacagtggttggtacttagccttgcctaattttctattctcaaatttttagtgcctctgtgatgaagacggagttaaaatatcaagcgttgtaccctagttgagtactcctgtggactgaagctaaacacccactaggatagtccttttccgccgttgcattcttttcggtatgaggactaattgtcacttttgtaaatatttatgctttatttatgtttggatatgtacaataacatgtcatttgatgtaccttgtgttgattcctaaacaaggatttaatacmcaaattggtctgaaaaaaggaaaaatttctgggtgtgaatcaccacacggcacaacagctcccactcaaaaaatgacacggcaacatagagcctacaccgcttctccaaccacatgaaaccatgctgccatagcataagtaggtggttattgttgctgagcttgccacctagttaggcagttgtgactctgcccatgcgaatgctccgcaactcggtggaaacatccagcactgccacctacatgcacggatcctcttctgctgcaagcaccaagaaagtattttcaatgccgaaggtcgcccatgctatgccgagaagacaccaaattggccaaactaccaagaacatgtgaatcccattgtttttttgtctagtgctctagtcttctagcaaagaccttatcaaaggtgtttgaagagtcaagggggataaagagaagtttgctcctatggcaacaaacggatcaatcagctatacataccgcctccatctctttcaataggaagtaccgcagggcttcaagaatcatgaccgacctcttacattggctacatactctgacactgatggtttgtgtttcgtgcaacggctctggctatatcctcatytccagcctcytygtgatkttgcmagctgrmgtwwatckkgrwtartgcgcaaacactggacgaacatctatgttcgtttccgatgcatcctaaccctaacacgtaatggtgaggtagttgtccatcaacataacttagattagcctatcgtgcagaagctgaatcagatgagcatgagacgaagaggcaaggtcttttgggggactattatacaattgtggtaggatatatatataattcgtatgctagcagagcaggggtattacgatgcaattcagttcctaagagaagggtgaaataggacaaaacaatggagaaattgaaggcagtggtatgttcttgaaccatggagaaattcgacggtaataaagtgaggagtgaagccaaaaatgttgggtggtataaactaaacttcctgtattttgatggtattaattgaacgattcttttttcctttccaatgaactaactaacctgacttgcaagcaacaaccactttgtaccttttcggaactttttttttctaacacgatatcaaatgagtctctacaatcataaatgtgaaagtatcaaattatcctatgtgtaaaccagaagcaaaaacatccatcggcttttccaaattctgtttcttcaaagctcacaaaactccacaatatccagtgagctcgatctgtgtcaccagtgcgagccagagaaaaagaaatgtaacttttagataaaagatcatcacaatccacctttaatctatcagaatgcttgcaagaaaaccaaggtaatcaataaaaatggtacaagtgatcgatcgagagtttgtcttcacgtcctttctcatacttcaaatacgttgcactcccaatcccaagtgatcaagaacaaaattaaattttctaaattacaagcaaatcaaagctcatcgaagt

SEQ ID NO: 5984 - DNA, 1970 bp, Oryza sativa
ttttcgcttcttggcatcctttcacatgatagcaatatcagctgtttataacaagttaggtaccctaggaagttgtagagatgtaatgccatctccctagaaaacttatttttatttttgcccttctgcaggctactccaggggatccagttgtggacaagtatatatccatggggcttggacgtgaagctgtctcatttgctgtgttgaactatggagataatccagcgaaggcatgctttttcccttatttatcttgtgatttatcattaccttctttcaacatatcatcaagaacaaaaaccattgctttgataactcaaaaaggttttcaaaggtcaacaagatagctatatacaatcagtatttgcagaagcactagggtttcttcttctagcaaaacagtgattgccattctgtccagttggtagtttttgtggaattcgattttctacttctcagggagatagaagtgtcttctgccattctaatcgccacgagcatttgtagacagtggaaaaaaaagagagagaaactgacaaggatgaatcctatgtacttgcaggtgaaggagtttgtgaaatcctacaacgctctccacgagatgggcttcacatcctcaaatgttcccgaactgctggccatccacgacaacgaccctgacaaagttatccagcacctgatcggcacatcatagtccagaacaaaactctccacatattcccccatgtataggtccatcttacgctggcaagcgccatacatgtcgcgtttttaatgatggtttcgagtgctagctattgtacgcgtatttccgctacgagtttcatgaactgactattgttgtgcttcccaagcggtttcataaacttaaccttgctttttgtgtcggatatatagagccagtaggtgatgattctgattgctgaaactttggttgctatacgtttgctactcctttttggtcgattcagcaatttcttcccgccgttgttcagtaagctccgaacgctgtgtgctgcacagcagcagccagattcctgtggcaatttgctggctggagctcactactggatagttcatgtccgtggatgacggttggttgtcacttgacatggtggcaaaatcactcgttcaataacgtgacgaacaacttccagatggtaagtaaacacgctaacaattactacctcagtcccaaaataaatgcagccatagttttccacgcccaactttaaccgttcatcttatttaaattttttttaaaaataatttaaaacataagtcataagtaaaatactgttcatattttatcatctcagaacaacaaaaatgctaattataaaaaaaattcaaataagacgaatgatcaaaattgagtgcgaaaactcatgactacacttatttttggacggaggtagtgcacctttttgcatgcctaaagcactggtttgggcatactccgtatgaaacaagcatatgtactgtggtgctgcagacaagtccagaatatgtgtcggccggtgactgttccatccacacactaagggcctaaatgtcattgaagaacttatcgtttgatctagaatcgaggatcactgttcaccacgctatcttttttctgctgaggatgagctttgcatcactggacagcaacaacgagcatgaacaagaacaaacaccacaatccatccccatctccttctctcccccataacgaaatcgttgcaatgctgtctcaatttctctcattaaaagaaaacaaaatcgttgcaatgccgtctcaatttctctcagaaaaagggaaaaaagaaaagaaaagaaaaaagaaaattacatttccagcccaacaccacgatctcccatctccttcctctctcccgctataaaacgacggcatgtcgcgccgtctcccgcctatcgccgatcgaagcttacgagctatctgctcttctctctctctccgccat

SEQ ID NO: 5985 - DNA, 1996 bp, Oryza sativa
  misc_feature (534)..(534): w = adenine or thymine
cgatgccggcatttgccaattgccgtggagaccttgttaaaggaaattgtaagcagagagatgcgatgggaaggcatattgctgaccctctgcctggagaattaggaggctggtgtgtgataaataaagcgtccgactagttccggcatgtgtttctagaaagattctgtgctgttcgtgttgccattttactctgaccaggcaaatcgttcgtctgttggttgttgtatgtatcccggccattgtggtcgccggcggtgtgcattggcatttcaggtgattttgtacatatgcttcttcttccttagagttggttgatgatgattctcgtctgaacaatgaataggaagtgtagcaagatccttgcgatgcatggggggtgctagcttatgattcttgttgggtacatttcatatgtagaaaatttcacaaattcaataggaacattgtgatatactagtgaagagccttttcactggttgagtaaatttttaacctactgatatatgtatatgaaacatactactagttttwatttatttatttttgtctgaatagtgttcagtcggtttcctttcaatttcttatcttacgcacacatgccgaactcgggttgctatctggcccgtcccaagacgagttctgatcggatccggcccagctcagccaatgccaagctgcagatgatgaacaagaagcatatggccttatcttatcttttcgtttatatttatacttatcagacaaaatttaaaattttaacactagatttaaaactaattttcaggtttttctcattaaaatttgtttttcaatctttgcttttaggtcgttaagaacacgtatataaaaattttattcacaaattacttctcatttacgaatatgccgtttggccaaacaataggcatctgaaggtgcaggtgacgggagcgaacaagttccagggcctccttccattctgctcaagcagcagcagggggaggaagaagtagttaccagcagtttattaattaggccaagtggacaagatcgatggcgcagaaaacgtaccctttccacaactgtataatctagattaaattttacaaaaactacatgtattttacattatttataacaaaactataaatttaaaagcttgtttttttcgctgggatggtgaagaatgccgacccgatgtatattaaggaaaagggaaaaactgtacaaacctcctcgggaggaggcacaaatgtagtgcatcaaaagcaccgcctttacaacattaagcaagtttcaaaggctataatctctctaaagctggtgctgcggcaacactcaatgagctaactagccctgctaattttcaagtttcccattcatcacacatgatcgcacacagttgtgtgaccgacgagcttgttttataaaattacaaattcagcgtctccgtttatcacgaaactagacatacttcgtgcaatatatccatcaacacagataatctctatatcggtaatcactaattagtgagcagatcatccatcaacatagataagatctacaattaattcgttacgaatgaccggtttcgtagtggtggtggagagggaggccgccgaccaaaccaaggtcctgcggccgggaaaacgatgtggcttttagtagcaggagtcggcagaaagcatgttggtcggagaagaacatatgccgtacgttttgtacaggtggtgcatccagaagaatctcgatcgcaactagcggggacgtgtgtccagtcctggtgttccgatcgatcgacgtggtgtacatgcatcgcgtccacgtaacagccattcatgcatgatgatcgtctttgtccatcgaccaaagtcgtccaagtgcagcatatatataatcggatgcaactcgagcaaccttacttcccatcatacgcactgcaagcttagcttggtgaggatcgatcgatcggagaagatcatcagattgataattaaagtaagaaaggtcgagg

SEQ ID NO: 5986 - DNA, 1927 bp, Oryza sativa
  misc_feature (1730)..(1730): r = adenine or guanine
  misc_feature (1775)..(1775): k = guanine or thymine
agggaagaagcatctcttggtcatcaatttaatgatgaacctccagctgattgtataaaagcatgttccccacttcagtcaatggtggacacaaatgaggaaatgctgctggctcatgaggtaatgaatcataccaaaaatataaagccatatcatgttgatgactctctaagaaataacaatgatatttcatttcatccatttaaggtaagtgataaccaacaagcatctgcagaacacgagcatttcagggaccaaattaacagccacagtgaaagcttgccacaatgccttcctgagctaaaccgccagcataatgattccatctctcaaactgcctctggtgataattatcaactgggatcaacagcatattcaagtcctaaggtagaaaacactgatgccactgggatatcggtactcttactccagaagtcaagtagcaataaatggcctgttgtggaaggaaggactctgtctgcaacaaatattctttgttcagaaccctattatacaagggatagtatcagtgctatgaggcgtagctttggacgggatagctcttcagcaacttcttccattgatctagggtcatcaaggcaatcagatgtacgttttgagcgtctcaggagtggcaagaggggtgatttcgagaaggctcgaatgagcagtaccatgagccatcaaagtgttgcttcagtgtcagatatgtcaattagtggttcatcagcttcactttgccctcagagtgatgttattggtgacacttgtttcccaattgacacgctggaaaggagtgcatcgagaacaacagtctctattgaagaacatgacagctcttgtatggatgctttatcaagtggtatggagtgttcatctgctgtgcagccgataatcaatgatgaaatccttgttgacttgaacacctcaggttttcataggttaagtgaaacagaagatatacttattaagaaccataatatggaaatggtggctgacaatgatcatttgagcactaacttgtgtttatcagatattgaaatgccaagtgatgccctagaatcttcagctgctgaggaaagttatataccaaaaactgaggaagatacttccaccaaagcacactgctatacaatcagcaccctagagcatccaagcgatgagaacaactttgatgatcttcaaatgcagtctgaagcagttcagtcttcaaatgaggaaaataaatccaatggctgttgcacgcttgctgtctctgaggatgacgtgttggtttctggaacagatactaacataaaggaacttcctaatgatggtatggtttcatgatttctaaatatgaacttttccatgtcaaatattctacttttctcataacttattaactcatgcttattctgtacttgcataaatcatgcattgctcctctatgttaaagtcttgtctgggaatcatgctttttgtattaaaggatctccggcctcatcttttcacttatgcttatgcttatcagccaaaatttaaattttcaactttaaatttggaattgattttagggtttttttcatcgaaatttatttttcagcctttgcttttaggtcactaagaacacgtatataaaagttttattctcaaattatttttcgtttgcaaatatgcagtttcgctaaacgatggggccgctcctttttttagttctacagaaattatttactctttcaaaccaaagraaaaaatatacagtgaagtaatgcatgtagattgtgtattttctkggataagaggtgctgtacagcagtatatagaagattatgtgtgactttttccatgttaaagataatatttatctcattttgcaacttacctaaaggaacatgcttcatgttattttcgctttatttttcctttggggttatgcacgctggat

SEQ ID NO: 5987 - DNA, 1893 bp, Oryza sativa
  misc_feature (678)..(678): r = adenine or guanine
  misc_feature (810)..(810): s = guanine or cytosine
  misc_feature (816)..(816): m = adenine or cytosine
  misc_feature (827)..(827): m = adenine or cytosine
  misc_feature (834)..(834): s = guanine or cytosine
  misc_feature (854)..(854): y = cytosine or thymine
  misc_feature (860)..(860): y = cytosine or thymine
  misc_feature (865)..(865): w = adenine or thymine
  misc_feature (872)..(872): s = guanine or cytosine
  misc_feature (875)..(875): y = cytosine or thymine
  misc_feature (891)..(891): r = adenine or guanine
  misc_feature (895)..(895): m = adenine or cytosine
  misc_feature (901)..(901): y = cytosine or thymine
  misc_feature (914)..(914): m = adenine or cytosine
  misc_feature (939)..(939): m = adenine or cytosine
attgtttagcaatttgggaaacatgagcgtgaaaaacgaggcaggtgaattgtgaacttaggctaaaaaacacagccatagtcatgggcctacctaaataacatttacatcgacaaattttgcacgatacgagcatatgaattagtaaaccacctctatttccaataaaacatctaaaataacatcatagggtgtttttttacctgtttttttttcaaggcgaaaaataaattaacttcgagcaaggtttaagggttgaaaatatacttcaccctaaaatttatccataccaaagaaagctagcttaagacgtgattgccattaactatataagtttgagacatttcttttatacatttgagaaagggtttgatgtaactaagctgctgaaataacgaaaaaccccacaccctatgtaaggttaatggtttcttgtcgtattagatataatttattaaactttcacgctatatcaattaactgaaacatctagaaccatccgttcaaatataccacggaccaaaatttcttatcaggacacatcatttatttttccgtgacgcaatgatttcttctctttacataaatgttttatcgtacctaaaagcaacgataacgtatccgaaacctggctattttatgtcgcgatgtaattagaacacgaaacatcccaaattrgggcatccagcttagaaaggcatttgtcattttaccgttctgttacaaccttttacctttccacgtaacactcggtttgtcgttgaacccctggatcctcccggaattcaggcaaatcttgtacgcttaagscttaamgccgcggaaamatttggstaaaatcccggtagcagatyaccatytttawattaagsatygcctgaatccccaagraacmccaatyaccagtttaccamtttaccattgccttccaggaacccmaaaaaaaaaaagcttaccaaatggcgtgtatgagtgtatcctcaattcctcaccatgacatcccagccgctcatcaacgtttccatcatccgcgatcgacaaatcctggccgttgatgcgtccagccccctcccccacgaggccctgctgacgtggcgcgaccaaccaccctctcctcccccggccgggggtataaaaggggggtctcctgccacctccgtctcctcagcgctctcctctccatttttttcctcctatcgattttgcaatttagcccctagggaggcagggaatccggctccggtccctgtgccgctccccccggctctccttgcctcccttgctcctccgatcgaggctgaagcggcttcaggtgagccccgtcctggcgattcttgattcgcttggatatacattttgtagcgagttcatcgtctcgatttagatttcgtttgtttttggctggccatggctttggggttgggtggattggaggaggtgaagtgaagtggttcttccaggaggagatttttggtggagattttggtgctgggagcctttgggttggggattgtgagctgtaggaaggtttaaagggagatgcctttggaggaaactgtactgaatttggtgagggtgtaggatgcatagagctatagaaggttggggaatttgctgctcgtaggagcttaggagagctcgaaactttggataatatcacaattgtttaggtgattagttacttgtcgattggttgtgttttgataacatagagtctggttgttggggtgtccagttttaggctaaggtcttgctctactcttactgtattactacaataagtacaagttctgaatgagtactaaattaagctggagttctcctttttagcaggcttttccggatccctgtgaagtgttgtagatatctaacttgcatattgtatcatgcagg

SEQ ID NO: 5988 - DNA, 1998 bp, Oryza sativa
tggcagaatagtctaagcaaaatctgattctaaacgatgaaggctactgaataaatttgattagggatgtcctaaggttagccctagggcatctaccccttggtcttagcccatgacataattacaaggtccaaggccaaatcagacttggtcaggataaggtacgtggcttgttttgcatattcctaacaacttaggagatgaaagtatactccataagctttccaacgagtactcatggactgtgagagttgtagttcctcatcaacatcctaacatagtccatgggcctccgtttgaagttgatgctgtcagaaggcccgaatccgaattcaaaatgtacagaacttaatgtcttgcctcttgtggaccaaaagtgacgtggtgatgtaggagtagactaaggaatgtcacttatttgatcatccattcatcccttgcgttcggtgtctttcccgtcacccaaaaacgtaactctgcaaataagaacacacaaaactcatggtgcaataatatttgttcaaatatataacacataaatcttacatagaatacatgcacctttggttgatatatagataatgtagccatggtcatatccgaactagtgttgtcctcatcacatcacttttgaaggaacctatatgcctagaccatgatgttttacaagacatgcattttttccatgcatttacctaacctcatatctcaaagtggaattcaaccaaatgaagttaaacttgcggcaatggttaaatttcttataacttaggagaaaaatcccaccgtctaaacatgggctaaagtatggctgatgtaatttcccaacgcataaaatggttctatgagaagtgcttcttgctaaggtatatgtccctgaattcattgcagtaaaggctttgtgggatgtctcctacagccaaggctttcctcggctgtaactgtcccatttgttacgtgttttctttgctttctaaaatgaagacatgcaatctacctgaaaacaaattgttctagaagaaagataaataaccgaaactatttggagagcattcaggttacatggttagtccatggtgctagatattgctatataatactcaatgcaatgctcaatagatataagtttcaaagctgtataagaattttaggttagtgtgcaatgtaagtgtagcttcttatagcttagtgctttactatcttcacaagcacatgctatagtattgttccaagatgaaagaataattcatccttgctaccaacttgcatgatattatatttgtgaatatcctatctcttggcttataatgaaatgtgctgctgggttatacctgaccatggtatttgagagacctttgtatagctgaaaccaacgtatatgcgagcatggaacaagagaacaaaatgcaaggatttttttatactggttcatgcccctggatgggttaatatcgtgatcatcaaaaaagatatgcataaaattaaagtaataaatttgctcataagaaaccaaaaccaaaagcacatatgtcctaaacaaactgcattttgtttgtcatgtagcaatacaagagataatatatgacgtggttatgacttattcactttttgtgactccaaaatgtagtaggtctaactgattgtttaaagtgatgtgcttactgtagaagtttcatcccaaaagcaatcactaaagcaacacacaacgtatagtccaccttgcacgtaattctttgtggaagataacaagaaggctcactgaaaaataaaagcaaagaaaaggatatcaaacagaccattgtgcatcccattgatacttgtatgtctatttatctatccaccttttgtgtaccttacttctatctagtgagtcacttcatatgtggacattaacaaactctatcttaacatctagtcgatcactactttacttcactataaaaggaccaacatatatcaccatttctcacaaaagcattgagttcagtcccacaaaaa

SEQ ID NO: 5989 - DNA, 1923 bp, Oryza sativa
  misc_feature (108)..(108): m = adenine or cytosine
atcgccttttcgatcttatggtcccataataattttacatagagttgtgtgctactcattcgtgtattcatacaaataggtccatcatgtgttcatcacattatatcmataacacttgaatttaacataacaatccatcactcataaaatcaatccatcctctataagcattcgaaggaaagacaagtataagtgttgagtgagttggagtgatgatggtccttgtcagattctatcatcgtagtggcataaatgtatgcaatacccaaagtttcaagtgagaaaagaacaaatctcacattttgagcagtggcatatccactgtgtgggttttgtcaaccgtaccactaatagtttttctataccaacactagttaaagactacgatcgaaatcctggtgataactatagctcctaatctaatggtcggttgctcgttactagtccaaagggatatttttttatcagttacgtcttattttcttacaatattactatttatcatttcacttcagaaggggaaaaaaactcgccttcaattttgaaattgtatcacagaaaatgagagtttttatttttccattgtctgttaagaccttgtaaccagctgaatatcatcttgctaggataccgatactcttcttattttttttatcgaaaccactctttgagacctgtgtggccatacacaagattacctagatggtgacaaccgatgtgcgatatttgtccgcacaattcattcacatatatacattctgacatagagtctgcatggattcacgaaaccaaatcaccttccaaaaccgctatgaagtccgttccctctgcttttcacgaaaaccatcttaaaaaccattgactagccgtgaaattcaattaacttttaccaaaactttaaaatctagttaaactcttttttcctagctcgaccaatttactgagcggttttgtgatctcaacccaacaaaaaaacctatttaagtttccgcgaaaaccaagtggtttcgtaataaaccatctgcgcacacgcacagaagcccacaaccttccccgcgcgcgagtaccagcctcgtcgccgggcaacccaaacgtgcccccgcgcgtgcgcgcgcggctccgtgctccgctctccagccacctatctattctagccccttacgttacggccttttacgttactacgtacagctaatctaccagctccgctttccatgaacaccgccaaaaagcccaaaacctcccttgctctttgcagctcatgctctttctttctttgcccgacgccaaattgccaatgcttcgattcacgccttccattccattccatcccagcctcctaacaaccagtagcacattgcttgcatgcctaccttcgaaaatcgcagagcacatgaatgcacctgcccaggaccacggccactgtccgtttcttcctcctcgagaaggagcaactgatcgaactgcgcacgcacgcagtagctagcatcgcatcgcccgtttctgttgcgagaaagaagcaagcaaagcaaagcgaagcgctgatcatgcgcggcacggcgcagcctgcggattcagtggcatcgtgcagccggtattgcagatgagacaagccgggagatggatgccgttggtggagtgcccggcggggagcggggcttgctagctgtgtggggggcttttcgtcgcgaggagtgcacgccaccgtgcaggtggtggacgggacggaatggctataaaatgggggcgccattgccaagaatcccaagaacaccagccaggaatcagaagccagaagcagcaacgctcgctctgattctttctttcctcctcgagctaggtgcgtagttgtcatatttgatcgatcggttttagttcttcttgtttaattttgattgcgcttgtagcagcaggaagtagttt

SEQ ID NO: 5990 - DNA, 1957 bp, Oryza sativa
  misc_feature (193)..(193): y = cytosine or thymine
  misc_feature (1791)..(1791): m = adenine or cytosine
  misc_feature (1793)..(1793): m = adenine or cytosine
  misc_feature (1802)..(1802): r = adenine or guanine
  misc_feature (1810)..(1810): w = adenine or thymine
ccgaagttaaggctgcggcagccagcgccgcttcccatctcactccccgaccgcatcccgccgtcgccgtaggaggaagcggaagcggtgccggcccaaggaggagcggcagctgcgccgttagcgtcggggcgcagaagctaaggctgtggcggccagttccgtcctacaccgacatcgcgctgctcccccytctcccgaccacattccgccgtcgctgtgggaggaagcggatggaagtggcatgaggcagaggaggccgacggcgatggctttgtcaattgggcaaacgggtccttccccgggctgccgaacgtcgtccccaccgccggatgccgacgccgccgactgccgcccctagttccgctgcgccccgatgccgccagccgccgctgccaacgagaagaaagagagaatataggagggagtcattgacaggtgggtcccactttatttttaaaatttatttgatgactggaatgccacgtaggtgccacgtcagcgaaaccgcccttcaaaaccgttgagtgagtcaaattgtactggttttaagagtttgagggtcgagatatctggttttgtggtttaggatcacgaattagatttcgatcacttttgagggtcacgaagtgaacttattccttcttgatgggtctgacggtttgggcccgtttggttatgggcctagttgagcgatcattttgagttgggcttagcatgggccgtcattgtacttgggctgctagagcaaaagctatcataaacatttttgtcatttagcaattttagtactccttttcttttttgaaacggcaagataaatgtcatgaatgcgagaagattaaaacggctaatgccagctgcatgccggatttcaaagccagaaaaaaatttgaacgaatacatgctttggattccatcaatgtgtttgtacacatgaccttttttttttcatcaaatgaaaagttcaaaacaaatatgaaaagtagacggaagaaaacaaaaaggaaaaaaagaaaggaagagatgctctgctgctctggtgggacccacctcaggggaggggatcagcttgactcaccctgacacgtcctgactcgccaaccgcctctgcctccaagtgcgtgctaatcctaatctctctctcgtcattagcagcgctaattaacccaaagtacataagattagcagtaatccgtaattagtggagtaattaatcaccaagcaatggcgctggcttggcttggcttggcttggcccgcgcgcgaagaagaagattcgttcaacgatcggacggccatccggaaagcaaggagaaaaatggagggacaggatcgctgcttaattagctggcaattgctttcttcgccgctacgtatcatgcatggacaatgcatgtgcttgtgcttccccttggtttaattctcgcttcgcttttttactcctccctttggtttactcacaaactttttttcaaaaaagaaaaatcttgatggttaggagtatttaagatacttggtgatttttttcatacatggtataatactataatttggatatggagaactcatacacactacgctttgtgccaaatacaataaaaatgagacgatctagatcatgttgtttatagtacgtaaatagaagagatagatatgtcaagttatgatgtttgtatatagaggaggaaagtatatgatatatttatcctacacattgtttccttctcgctttacacgttagtattttggttcgctcgcacctttttctatcttaattattacttattcmamacattgtcracgtggtwatgtatgtataccgtttattagaaaagcataccgacaatgtagcgttctcgatatattttccagcattgtttctttccgcctttttacgtaaggtattttcgaaaacaaattatacacaatcaacaacatatgtgtcgtttatcgcg

SEQ ID NO: 5991 - DNA, 1364 bp, Oryza sativa; identical to SEQ ID NO: 5942

SEQ ID NO: 5992 - DNA, 1491 bp, Oryza sativa
atggcaagtaatgcaacaaggaatactgatcctgaccaacagggtgttcgattcagttccatggaccagcctccatgttttgcaagacctggtcaatcgttccctgcttttcctccactctttggggttcagtcttccagcttgtatttacctgatgacattgaagctaaaatcggtaaccagttcgaatcaaatccttccccgaataatcctacaatggattgggaccctcaggcaatgctgagcaacttatccttccttgagcagaagatcaagcaggtaaaagacatcgtgcagtctatgagtaatcgtgagagccaagttgctggtggttccagcgaggcacaagcaaagcagcagcttgtcactgctgatctcacttgtattataattcagcttatttcaacagctgaacccaatcagcagcaaccgggactcagacatctcagtaacacactttgtgctcctatgatcctgggcaccaattgtaacctgcgaccaagcgcaaacgacgaagccacaattcctgacattagcaagacccatgactatgaggagctgatgaatagccttaatactactcaggcagaaagcgatgagatgatgaactgccaaaatccttgtggtggggaagggtcagaaccgattccaatggaagaccatgatgtgaaggagagtgatgatggtggtgagagagagaatctcccccctgggtcttatgtagtattgcaattagagaaggaggagattttagcaccacatactcacttctgcttgatctgtggcaagggttttaaaagagatgctaatcttaggatgcacatgaggggccatggagacgagtacaaaactgctgcagctcttgcgaaaccttcgaaagattctagcttagagtctgcaccagttacaaggtactcgtgcccatatgttggctgcaagcggaacaaagagcacaagaagttccagcctctcaagacaatcctgtgtgtgaagaaccactacaagagaagccactgtgacaagagctacacctgcagccgttgcaacaccaagaagttctcagttatcgcggacttgaagactcatgaaaagcactgtggccgcgacaagtggctatgctcgtgtggaactaccttctcaagaaaagacaagttatttgggcatgttgctcttttccaagggcacacgcctgcactccctatggatgatatcaaagtaacaggagcatcagagcaacctcaaggcagcgaggcgatgaacaccatggtggggagcgctgggtataacttccccggtagctcatcggacgacatcccaaatcttgacatgaagatggctgatgatccacgctatttctcgccattgagctttgatccttgcttcggtgggcttgatgacttcactcgacctggatttgacatctctgagaatcccttctccttcttgccctcaggatcatgcagcttcgggcagcagaacggagacagctga

SEQ ID NO: 5993 - DNA, 239 bp, Oryza sativa
atgaagcgccctcacgcaccggcaccgagcaggtcgcacgctcgtcccgctgccgtccacattgataacgcatccgtccagtccaacgactgctaccgccggggccgggaccgaaggggcatctggccgggtgcagcggccgacaagtgtaccgcgcaagtgcttttcgcacgggagaacgcacgggatttgggtggtaactgctggatcgggccaatccgcggtcggatttagaataa

SEQ ID NO: 5994 - DNA, 1599 bp, Oryza sativa
atggcgggatcgcagctcaacgttttggtcaagctcgaccaggccaagacgcaatggtaccatttcatggcgatcgtcatcgccgggatggggttcttcacagacgcctacgacctcttttgcatcgcgctggtcaccaagctgttgggtcgcctttactacaccgacatcaccaagcccaacccagggacactcccgcccaacgtgtcgtccgccgtcaccggcgtcgcgctctgcggcacgctcgccggccagctcttcttcggatggctcggcgacaagctcggccgcaagagcgtctatggaatggtcgtgtgctccatcgcctccggtctctcgtttggccacacgcccaagagcgtgattgccacgctctgcttcttccgcttctggctcggcttcggcatcggcggcgactacccgctcagcgccaccatcatgtcggagtacgcgagcaagaagacccgcggggccttcatcgccgccgtgttcgccatgcaggggttcgggatcctcttcggcgccatcgtcgcgctcgtcgtctcggccggcttccgtcacgcgtacccggcgccgtcgtacgcccagaaccccgccgcgtcgctcgcgccgcaggctgactacacgtggcggctcatcctcatgttcggcaccatcccggctgggctcacctactactggcgcatgaaaatgcccgagacggcgcggtacacggcgctcgtcgcccgcaacgccaagcaggcggcggctgacatgtccaaggtgctccacgccgagatcgaggagcggccggaggtggtcgagagccaggtggtcgccggggagacctggggcctcttctcacggcagttcatgaagcgccacgggatgcacctcctggcgaccaccagcacgtggttcctgctcgacatcgccttctacagccagaacctgttccagaaggacatcttcagcaaggtcgggtggataccgccggcgaagaccatgaacgcgctcgaggaactctaccgcatctcccgcgcccaggcactcatcgcactctgcggaaccatcccgggctactggttcaccgtcgccttcatcgacatcgtcggcaggttctggatccagatcatgggcttcttcatgatgaccgtgttcatgctcgcgctcggcgtgccctacgaccactggacgcacccggcgcaccacaccggcttcgtcgtgctctacgcactcaccttcttcttcgccaacttcgggcccaacagcaccaccttcatcgtgccggctgagatcttcccggcgaggctccggtcgacgtgccacggcatctccgccgcgtccggcaaggccggcgcgatcatcggcgcgttcgggttcctgtacgctgcgcaggaccagcacaatcccgacgcgggatactcccgcggcatcggcatccggaacgcgctcttcgtgctcgccggcacaaacttcctcggtatgctcatgacgctgctggtgccggagtccaagggcttgtcgctggaggagatgtccaaggacaacgtcgtcgacgagaccgcccaagaagcgatcgcccaagcgtgatgtcataaacatgccgtctcgacgtga

SEQ ID NO: 5995 - DNA, 1719 bp, Oryza sativa
atgtctcaatcttcccctttcttctccgttgcccgagcacatgctggagcaggagggcgagctgcggctgccgctctcctgctccgtcaccctgttgctcagctgccacctcggattcatggcctgaggtactacccttcagccattgtgtcacctgccaagacactgaactcacacctgagccttccccatgccacaatatcctcctttgccaatgctgataatggctccagcgggcaagcagatgccacagagtctgaggaggagcagaacggggaatctgaactgtcggagatggccaaggcattccatatatcgccccggatggcaatgtcaatctcagtggtgattgcatttgcagcgctcactgtgccactggcgatgcagtcagtggtcttccatgggacgaacaaaatgaaggcactggcatatctgacactgctttcagggttctacatggcatggaacattggggcaaatgatgtggccaatgccatggggacgtcagtagggtctggtgctttgacactccggcaagcagtgcttactgcggcggtgctagagttctctggtgcattccttatgggcacccatgtcaccagcaccatgcagaagggcatcctagtcgcatctgtcttccaaggaaaggactctctgctcttcgctggattgttgtcatccctcgctgctgctggaacatggttgcaggttgcttcctcctacggctggcctgtttcaactacacattgtattgtcggggccatggttggttttgggatagtatttggaggcgtaaatgcagtgttctggagctccttggcaagagtatcttcatcatgggtcatttcaccattgatgggtgctgcagtctcatttattgtttacaagggtatacgaaggttcgtatatagtgcaccaaatccaggtcaggctgcagctgctgctgcaccaattgcagtttttactggtgttactgcaatatcatttgccgcttttcctctcagcaagactttttcaatcgctatcctgcaagcattagcatgtggcgcaataggagccgtaatcgttaacagagtgatccaaaaacagcttggtgacctactgtcctcagaagcagaaaagatagcatctgctgataaggcaaatgctcagcaagttggatttctttcggacatagctggaccaacaggagctcaattgcagattgtatatggtgtatttggatacatgcaggtcttgtcagcatgcttcatgtcatttgctcatggaggcaatgatgtctccaatgccataggccccctggcggcagctttgtccattcttcaaggtgtagcaagcagtgctgagatagtcatacctactgaagtccttgcttggggaggttttggaattgttgcagggcttacaatgtggggttacagggtcatagcaacaattggcaagaaaatcaccgaactaacaccaactagaggttttgcagcagagtttgcagcagcttctgtagtattgtttgcatcaaaacttggattgccaatatctgctacacatacacttgttggtgcagtgatgggagtgggatttgcaagagggctcaatagggtcagagcagagacagtgcgtgaaattgtggcctcctggttagtcacaattccagttggtgctgtgttatctatcttctacacattgctcttcacaaagattctggcatactttatgtga

SEQ ID NO: 5996 - DNA, 733 bp, Oryza sativa; identical to SEQ ID NO: 5974

SEQ ID NO: 5997 - DNA, 1999 bp, Oryza sativa
catcaggagtgatccctgttacttggtgccaccactttctctgctaagtgattctttatttgtgataatttaaaattaaaatacaaaacactatttttttactacaagaaatatgtagatgcatgcacagaaaaacaatcacagttgcctagccatatgaactaaaattttagcatatcactacttataacaaaagtacgttggcacatatatatatatgaggaggcgtttccagtagaaattttgattgggtcatagatttgttgttagactcttttctttgagcgtcgtgaattggagtaggaatttacatatgttgtgattttctttggaattaaagtggattacttttaaagtttgattttaaagaataattttagatagacttttatatgtgttctaagaaattattaaaatagaactagacaaacaaagtggtaaagaaaacccttgaaataaatttagaattaagtcaacttcgattatatatattcgtagttcaaccagcattcatcatgcaataaagtaatgattttatttataccctgagtaagttttttttaaaataatttatcacccatataaaggaggcaattctcgctctcactaacatattgaactatttttgtcactaaatgtggactgggatagcaaattgtatccaacttaagaatgtcatattaccaaatgtcccagttataaaataataattatatttacacaccatgactttgtaaaataaaatactgtaccttttttttaagatgacttgtcattttcttttcatgcagccttattagattatgttgtactatcaaccaaaactaatgtcttgccttgtactgtttccacgttcatggctgatggcctcatgggccaatgaccttgggggttgctaaaagtcagaggagcctgatcccaatatctcatattcccagggacccctccgtaaatttgtgtttttgcccacgaagaaataggaaatcgtctcgccgttcgccaccacggtgactcgactagtatttcccctcgctcgccgtcgactcctccgctcgccgccgccgccgccctcgccgtcgccgtggcctccgccgatccgatcccaatccatcccggcgaccgcgagcagggcgcggggcttcgtcgttcgtcctgctgattccgccgcatcgcgtcgcggtatagcatccgatcctctttttctcatctttttccccccagtttgcgttagccctttggtcatttctctgcgtcatagacatggaggaagtttttttctctcttgatttgctttaaccttgatatattaataaaaagttttttttgttccacccaaaaagtttgggggattcaactgaatcccctcatgtcccatgttagatccgatccttctttgttagcaatagcatatatcaagctggttgaattagtggagagatgatgatgatgatgagctgagagttagttccgagttctgactagtcagcttggtttgttggttggttgttctacttgttgataggcttttctccctgtgtattaattatcttctcgcttgcttccagaaatatttttttattaaaaaggtttgggttttctactagagataggcttaaaaaatatgttttccttagttttttttcctcgctcttttgggctagaaatgtccatctatttatgggagtattcatggttaatttcatcctgtcagcgacatggaagaaaaccagaaaatcagcagtggcttctttccaactacgacctgtttaattgattggtctcgaactgttggttgttgctgcgttcagtttggtgttctaacaatctttatcatgcatcccaggttttcatgactgccctatagatcagctcctgattggaaggactgtagttccatgagatagaagggcatattgaagtagaatttggcctttggtgaatctaaatggacagtggcttgggaagaagttcagagacatccttgaaagccttgccatca

SEQ ID NO: 5998 - DNA, 1998 bp, Oryza sativa; identical to SEQ ID NO: 5976
  misc_feature (321)..(321): n = any nucleotide
  misc_feature (329)..(330): n = any nucleotide
  misc_feature (345)..(345): n = any nucleotide
  misc_feature (349)..(349): n = any nucleotide
  misc_feature (370)..(370): n = any nucleotide
  misc_feature (444)..(444): n = any nucleotide
  misc_feature (449)..(449): n = any nucleotide
  misc_feature (451)..(452): n = any nucleotide
  misc_feature (461)..(461): n = any nucleotide
  misc_feature (466)..(466): n = any nucleotide
  misc_feature (494)..(494): n = any nucleotide
  misc_feature (496)..(496): n = any nucleotide
  misc_feature (509)..(509): n = any nucleotide
  misc_feature (515)..(515): n = any nucleotide
  misc_feature (517)..(517): s = guanine or cytosine
  misc_feature (526)..(526): n = any nucleotide
  misc_feature (528)..(528): n = any nucleotide

SEQ ID NO: 5999 - DNA, 1740 bp, Oryza sativa
  misc_feature (54)..(54): s = guanine or cytosine
cacaggtacaatttttctaatttagatctcttttcccaagtttttgagtttttstttttcccaccatcgttcgattagtagttgaactgttgaagacaccaaatgacatcagcaggcaattgccaagattttattctggaacttcccggatgtttcctctgttttatattatactccctccatctacttttgatagtcatatttccaaatctaaaaaatttatttttgatagtcatatttcaatccaacaacctattctcttaatgactttcttggatttaatgcatgactccccattcttccacgcatgattggctacatgggcattgagaaatgttaatattaatgaatcgtttgtttacgagaaatgactagtagcatgtttaaatgaatgataagtagaattacttatccttggtctgcgtggcaagatgaaatatgactatcaaaagtagatggagggagtatgtcgtttgatctttttctaattaaacttcaggcttgttcagattgatgctatttcaaaccataccattttttatagagttgtcaaatatgtgtatctatttagtttcttgctaaattttgataaatacataagaaatcgtaccaaaattttagtaatattgtcaaactaccaaaattttaaatttatcttggctacaatctgaacagcccttctttaagtttgactaagtttaaagaaaaatatagtactattttaaacacaaaacaaacatattatgaaaatataaaatgtattcaatgttaaactagttaagtattttagatgttgctaatctttttataaatttgatcaaacttatcaaagtttaactagagaaaaggctaaacgacttataatatgttataatatgaaatcggaaactgatggtgtaggacttaaccaaatgatcactgctcaagaccaagaccctatttgcatgcatagctttgtcactgcccagccgatcctgacaccgtagaattctaaacagtgggaggccatacgctgatatgcatagatagttgaaagttaatttcacattccacgatcctgcaaatagaataacatttgacttctgtacgggcattttaaagacaatatatgtcactatctgcttgcaatctacagtatgtacggtacatgcaatgcagtagaaagaaaatcttttttctgcaaccatgccctgtctgtatcctgtccggactgcgctgcggctatatatacagcaccatggcaacagagatgaggaaactaacagagcacacagcgatcccctctgctctctctccggagtcaacccatcctcaatcttcccaaggtacgcaaccctctctcctgcatctgagttccatgttagcagagatgctagattaattagtgttgcggtttagcatattcaggaaacgttctactgaatatttgttgaatcatatgcgtaatattattacccgccaataagattagttgtgtaaacatgtgcttctactatttagtacagtacgcattaaaaatggacacacccctatctattgaagtttcaattactgagcggtaaatcatgaattctcaatctcaacagtgcgaaacctgaaatttctctgttcaattaacattcaacgatctagtcagatataaatggagatgcctaggtgaagaattttctattcttttgtgatatgttgtctgtactaagcaaagcttataactttgcagcttgaggaaaaaagatcatc

SEQ ID NO: 6000 - DNA, 2059 bp, Oryza sativa
  misc_feature (316)..(316): r = adenine or guanine
  misc_feature (1192)..(1192): k = guanine or thymine
tcattggctatttgcgttaccttccaaaacaaggagtacctatgcatctttcgaaagatttctatgatcatatcatataaatttttaatctttggattaaaatccaatagacatagtaaaaggcaaaaagcaactaagaaacaccataatagatactaaattaccatatctttaagaaaaagaccaaatccaatataaatttcaaaacttacatgcgaagattcaaaaattacactgtaagtttcataaattacactataatttacaagaaaatacactgtaaatttgagtgagaaaatcgagtgagagataaagraaaaatctttcaagtgagatatagcaaaatcgcagaacaattcgagtccaagattattattcattaaatggacttcactgagtcatttcttgtgaagggatttcactatgttattttgatcataaatctagagttaccacttttactccccataatttgattagactttcaaggaaatattgtacgtcaaaatttgatatctcaaaatcaaaccgataaataaacatggtttgcttaaaatataacaccacatttttcacgtaatttcaatcatttttttcctatgttattgcgctctctcccctatatatataagtatgcttctatctctcctgtttgcggccgtcgaacttgcaaatggctcagtggtgccctgcaatttggtcgagttacaaatctccatttggagctacaagtatactactactcagtatctttgtttttaagttatcgtacaaattcagaagcaacaccaaactgaaatcacaggaagattcttatacctaactacagattcgaaagtgaagtcggcaaaaggagaatcagccataagaaatcttgaaactgtgcacgctttaaagacacaatacttcatccacaacacacgacttgcagggaaaaaaaaatgtcgacctgagccctggccaactcgatgagcagaaaatgtgtctagtgcggtgtctgctaaatgataaattgtggccaatctctagtgatcgtagaagacaagatcaagtattccatacctgataaattgtggccaatctctagtgatcgtagaagacaagatcaagtattccaaacctgatacagggacaaagacgctgattattcttctcttcagcatccggcctggagcacacaagttgatttcckgttctgtggtccttggccagcagcgctccaatcgctactgccaaacgggaaccaccggtccatctcaccaacaaaaagaaacacgaagcaaacgcataagcatgcttacaatcttattcttggaccacagctgcgttcacttgttaaacatttattagtcgaacaagaggaaatatgcataccctgatacccatgagaagccagaccagtgttgacttcctctgcaattaaatagatttctgagcatggaaaatcttgattactaacaccgactgtatatctgaagagtcaccgtttgtgtgtcataagaacagtacgtttttctgtcataagaacagtacatataacatgagaacttcacatgtaactgtattagtttcatttatctgcacagtagatggcatcagctttagaaccacagacgcaagtatcttcagaagccttccatattaaactgatgcaagatgttaatgtcatgctaaatattgcactggagaatcaaaacaacagaaacagacaacagttagatctttaaaaaagacgatggagggaagggtggccctgatggtaacgcagactgaaaacagtcaagtggtcagctgcaaccccaggttatggattaggctggaatcttgctcgtatccccttccaccactcattccaagccaccactcgttcatctcagcccgagctgggccaccacagaaagcaagccctttcctccatccacaaaacaatgctcacttcattccacaaacacctatggccaccgcttctcattcaccttcctcctctcctcccccttaatctcatctttttcttctcggtgcttctctgctcaaacctgtactttgcttctgccacttc

SEQ ID NO: 6001 - DNA, 1955 bp, Oryza sativa
  misc_feature (396)..(396): y = cytosine or thymine
  misc_feature (399)..(399): w = adenine or thymine
  misc_feature (1368)..(1368): y = cytosine or thymine
  misc_feature (1687)..(1687): k = guanine or thymine
ccctactttgagcgttttaatggatgatactactagttctggatcaaattggctagatgtttgtttcactgttcaagatattgttaataacctgcttgcagtatcacagatagacaaacttaggcttatttcggagctgcttggctgagctgcggaaaacacagcgggtgattattagtgcataatgaactaagtattaattattgctccctccatcccaaattataaggctcaaacactcctatcgcaattaccaagaatgaatttaatcacctcctcgattggatcacatccatacatgcaagcaatgtgattggggggcttgatggtagctgatttaaaacaaaccaaatataaaggaccaagaggtgctagttaatgcattcatgcatgccytawaattttgagacatgagaaaaaaagtggttgcgccttatagtttgggatggaggagtataaattttaaaaaatggatttatttgatttgttaaagaaacttctatatagacttatttttttttaaaaaaaacatgcaccatttagcagtttgggaagtatgatcacactaaacgagggagtagctcactccaacagtcgggaagaacaggggcttagagaagcagtgacatgtcttatttaatacatgtatttatctgtggaagtttagcagcctactgtgagcatacgcaatctttagtacctcctgtagactgtagttagtgttaatctcacaaagcttattctaacattctaaaattatgcacgctaattatctcttcaccctgtggtttcacgggtgataagcagaactatacaaagtttatatgcacacatgcacacccctttcaaagtttcatacctataaattcattgtgacagaaagggtcttcttaagtgaaacatcacacgaggtgggaacagtggtagatgatgactagaaagataagggagggccagataatgaacaaaattaacagtgtttagagagtattctcttttggtacatatcttctagttgcagtgtcatacacttgattcttcctaggttctctaacttgtcctaaattagcagtatttcgcaaaagataagagaaggcatacccgaacagaaagctctacagaaggtcattaatgcataagtggatgattaagcattaaaacataataaatcgagaagtcagtaggaaactccccaactatcatcctaaaaaaacataagttaagaagtgccacatataggtattaatattcacaaccctggtgcttgttatgctaccaacatgttatatggttttgtatttttctccttcctcaaaagcatcccatctctttatgcaattctatgttatgttttgctttgccttttcyctgaaggtggtccatttcttaaactccaccttgcacctgctctttctttccttttttttttcttcaaagctaactacctaataccattgcatccaggaattcagctgggatctggacaaaatccttttaaaagcttgctcgttttaacgtctttattcagtattgttctcttgtgtagattgtggtatagctccctccctaaacatgtcaatttatcagttgatggttcccgaaccgtgaaccaccacatgtgtaggattaaacttgtgctgttgacctagctagaaccctataatttagggacaatggctcatctctkgttacctatatatagctagttattatgtttctctgaatcaactttcatcagaaccactcctctttgtcgttgcaatattgaccttttgtttatcaatatgcaagtctactaccatgtaaattgccaagttctacatgtgtcacattatgcatcacatagcgattacaataacttaacatttgtttttcttaatctgattttcaggtagaggtgatgataaatcatagttagtgacttagcttgcagcagttctttcttgcagctaaga

SEQ ID NO: 6002 - DNA, 46 bp, Artificial Sequence
  Artificial PCR primer used in conjunction with SEQ ID NO: 6003 to amplify a rice gene promoter
tacaaaaaagcaggctcaaattttgggtcatggattagtttcacgc

SEQ ID NO: 6003 - DNA, 48 bp, Artificial Sequence
  Artificial PCR primer used in conjunction with SEQ ID NO: 6002 to amplify a rice gene promoter
tacaagaaagctgggtcttctcctatctgcataaaatggtatttcaca

SEQ ID NO: 6004 - DNA, 44 bp, Artificial Sequence
  Artificial PCR primer used in conjunction with SEQ ID NO: 6005 to amplify a rice gene promoter
tacaaaaaagcaggctcaagccgctttcacttgacggaacttgc

SEQ ID NO: 6005 - DNA, 48 bp, Artificial Sequence
  Artificial PCR primer used in conjunction with SEQ ID NO: 6004 to amplify a rice gene promoter
tacaagaaagctgggtggcttatttgcaccggtataaagttagggatc

SEQ ID NO: 6006 - DNA, 40 bp, Artificial Sequence
  Artificial PCR primer used in conjunction with SEQ ID NO: 6007 to amplify a rice gene promoter
tacaaaaaagcaggctaggcaacccacccttcggtggttg

SEQ ID NO: 6007 - DNA, 51 bp, Artificial Sequence
  Artificial PCR primer used in conjunction with SEQ ID NO: 6006 to amplify a rice gene promoter
tacaagaaagctgggtccacgatgcagaataaaggcataaattcagaagca

SEQ ID NO: 6008 - DNA, 47 bp, Artificial Sequence
  Artificial PCR primer used in conjunction with SEQ ID NO: 6009 to amplify a rice gene promoter
tacaaaaaagcaggctggcaccttcaagtaccagtttccttgaaatg

SEQ ID NO: 6009 - DNA, 44 bp, Artificial Sequence
  Artificial PCR primer used in conjunction with SEQ ID NO: 6008 to amplify a rice gene promoter
tacaagaaagctgggtatccaaactactctccgcgaagtgtgtg

SEQ ID NO: 6010 - DNA, 47 bp, Artificial Sequence
  Artificial PCR primer used in conjunction with SEQ ID NO: 6011 to amplify a rice gene promoter
tacaaaaaagcaggctgcaacgaatttaatggtgcaatcggatcatg

SEQ ID NO: 6011 - DNA, 40 bp, Artificial Sequence
  Artificial PCR primer used in conjunction with SEQ ID NO: 6010 to amplify a rice gene promoter
tacaagaaagctgggtcgcagaggcttatatagaggggag

SEQ ID NO: 6012 - DNA, 47 bp, Artificial Sequence
  Artificial PCR primer used in conjunction with SEQ ID NO: 6013 to amplify a rice gene promoter
tacaaaaaagcaggctgctctagctttagtcccggtttggtaacacc

SEQ ID NO: 6013 - DNA, 46 bp, Artificial Sequence
  Artificial PCR primer used in conjunction with SEQ ID NO: 6012 to amplify a rice gene promoter
tacaagaaagctgggtcttgcttcctcttctctctcctctccgatg

SEQ ID NO: 6014 - DNA, 46 bp, Artificial Sequence
  Artificial PCR primer used in conjunction with SEQ ID NO: 6015 to amplify a rice gene promoter
tacaaaaaagcaggctgtcgacgttacatgaggaactttcttgtgc

SEQ ID NO: 6015 - DNA, 40 bp, Artificial Sequence
  Artificial PCR primer used in conjunction with SEQ ID NO: 6014 to amplify a rice gene promoter
tacaagaaagctgggtcctcgggtgttttggtttggagag

SEQ ID NO: 6016 - DNA, 46 bp, Artificial Sequence
  Artificial PCR primer used in conjunction with SEQ ID NO: 6017 to amplify a rice gene promoter
tacaaaaaagcaggctcaggccatacagctctatcgcctcagccag

SEQ ID NO: 6017 - DNA, 48 bp, Artificial Sequence
  Artificial PCR primer used in conjunction with SEQ ID NO: 6016 to amplify a rice gene promoter
tacaagaaagctgggtcacacacacacacacaaaggcccatcaggccc

SEQ ID NO: 6018 - DNA, 48 bp, Artificial Sequence
  Artificial PCR primer used in conjunction with SEQ ID NO: 6019 to amplify a rice gene promoter
tacaaaaaagcaggctgcatcctcaacatactgaaacaatgtactaac

SEQ ID NO: 6019 - DNA, 36 bp, Artificial Sequence
  Artificial PCR primer used in conjunction with SEQ ID NO: 6018 to amplify a rice gene promoter
tacaagaaagctgggtgtggaggagcacgcagagga

SEQ ID NO: 6020 - DNA, 48 bp, Artificial Sequence
  Artificial PCR primer used in conjunction with SEQ ID NO: 6021 to amplify a rice gene promoter
tacaaaaaagcaggctatgccagccaaattgccggccaaagtgccaac

SEQ ID NO: 6021 - DNA, 39 bp, Artificial Sequence
  Artificial PCR primer used in conjunction with SEQ ID NO: 6020 to amplify a rice gene promoter
tacaagaaagctgggttgccggccggtgggctggtgcct

SEQ ID NO: 6022 - DNA, 49 bp, Artificial Sequence
  Artificial PCR primer used in conjunction with SEQ ID NO: 6023 to amplify a rice gene promoter
tacaaaaaagcaggctccaatatggatacaatccgagtagtccttgtcg

SEQ ID NO: 6023 - DNA, 43 bp, Artificial Sequence
  Artificial PCR primer used in conjunction with SEQ ID NO: 6022 to amplify a rice gene promoter
tacaagaaagctgggtcgtccatctttccttgctcctctcact

SEQ ID NO: 6024 - DNA, 41 bp, Artificial Sequence
  Artificial PCR primer used in conjunction with SEQ ID NO: 6025 to amplify a rice gene promoter
tacaaaaaagcaggctcgagcaggtatcgagcattgccgtc

SEQ ID NO: 6025 - DNA, 47 bp, Artificial Sequence
  Artificial PCR primer used in conjunction with SEQ ID NO: 6024 to amplify a rice gene promoter
tacaagaaagctgggttgtcacccaccccaatcaagctaagctatct

SEQ ID NO: 6026 - DNA, 41 bp, Artificial Sequence
  Artificial PCR primer used in conjunction with SEQ ID NO: 6027 to amplify a rice gene promoter
tacaaaaaagcaggctatgtgtaacacgcatggtgtgatgg

SEQ ID NO: 6027 - DNA, 41 bp, Artificial Sequence
  Artificial PCR primer used in conjunction with SEQ ID NO: 6026 to amplify a rice gene promoter
tacaagaaagctgggtgttggatgaggagaaggatggatgg

SEQ ID NO: 6028 - DNA, 45 bp, Artificial Sequence
  Artificial PCR primer used in conjunction with SEQ ID NO: 6029 to amplify a rice gene promoter
tacaaaaaagcaggctgtgctgtaatagcttgcctttgctaaatc

SEQ ID NO: 6029 - DNA, 47 bp, Artificial Sequence
  Artificial PCR primer used in conjunction with SEQ ID NO: 6028 to amplify a rice gene promoter
tacaagaaagctgggtgcttagtagtagtaattgttattgtctccgg

SEQ ID NO: 6030 - DNA, 41 bp, Artificial Sequence
  Artificial PCR primer used in conjunction with SEQ ID NO: 6031 to amplify a rice gene promoter
tacaaaaaagcaggctagcatcaagaaccagtgaacgatgg

SEQ ID NO: 6031 - DNA, 41 bp, Artificial Sequence
  Artificial PCR primer used in conjunction with SEQ ID NO: 6030 to amplify a rice gene promoter
tacaagaaagctgggttaagggggtgtttggatatagggtg

SEQ ID NO: 6032 - DNA, 41 bp, Artificial Sequence
  Artificial PCR primer used in conjunction with SEQ ID NO: 6033 to amplify a rice gene promoter
tacaaaaaagcaggctgaactctggtcgtcatcaccacacc

SEQ ID NO: 6033 - DNA, 41 bp, Artificial Sequence
  Artificial PCR primer used in conjunction with SEQ ID NO: 6032 to amplify a rice gene promoter
tacaagaaagctgggtttggagagctcgagagagagggttg

SEQ ID NO: 6034 - DNA, 41 bp, Artificial Sequence
  Artificial PCR primer used in conjunction with SEQ ID NO: 6035 to amplify a rice gene promoter
tacaaaaaagcaggctgcgcaaaacggtataggtctgaacg

SEQ ID NO: 6035 - DNA, 41 bp, Artificial Sequence
  Artificial PCR primer used in conjunction with SEQ ID NO: 6034 to amplify a rice gene promoter
tacaagaaagctgggtagagactggtagtagcagggggtgg

SEQ ID NO: 6036 - DNA, 48 bp, Artificial Sequence
  Artificial PCR primer used in conjunction with SEQ ID NO: 6037 to amplify a rice gene promoter
tacaaaaaagcaggctcgcatatcttattgctccgtagttcgtatgag

SEQ ID NO: 6037 - DNA, 34 bp, Artificial Sequence
  Artificial PCR primer used in conjunction with SEQ ID NO: 6036 to amplify a rice gene promoter
tacaagaaagctgggtctgctcggcgaggcaggg

SEQ ID NO: 6038 - DNA, 41 bp, Artificial Sequence
  Artificial PCR primer used in conjunction with SEQ ID NO: 6039 to amplify a rice gene promoter
tacaaaaaagcaggctacgatcagactcctaattgccgctc

SEQ ID NO: 6039 - DNA, 36 bp, Artificial Sequence
  Artificial PCR primer used in conjunction with SEQ ID NO: 6038 to amplify a rice gene promoter
tacaagaaagctgggtcattgcggccaaagcaaagc

SEQ ID NO: 6040 - DNA, 41 bp, Artificial Sequence
  Artificial PCR primer used in conjunction with SEQ ID NO: 6041 to amplify a rice gene promoter
tacaaaaaagcaggctctcggaacacgaaaaccaactcaac

SEQ ID NO: 6041 - DNA, 41 bp, Artificial Sequence
  Artificial PCR primer used in conjunction with SEQ ID NO: 6040 to amplify a rice gene promoter
tacaagaaagctgggtttccgatctcttcccatttccattc

SEQ ID NO: 6042 - DNA, 42 bp, Artificial Sequence
  Artificial PCR primer used in conjunction with SEQ ID NO: 6043 to amplify a rice gene promoter
tacaaaaaagcaggctggcataggattatgaatggatggtgc

SEQ ID NO: 6043 - DNA, 37 bp, Artificial Sequence
  Artificial PCR primer used in conjunction with SEQ ID NO: 6042 to amplify a rice gene promoter
tacaagaaagctgggtcatccttagatgcgcggccag

SEQ ID NO: 6044 - DNA, 49 bp, Artificial Sequence
  Artificial PCR primer used in conjunction with SEQ ID NO: 6045 to amplify a rice gene promoter
tacaaaaaagcaggctggagcatgtactctttataactaactttacatg

SEQ ID NO: 6045 - DNA, 34 bp, Artificial Sequence
  Artificial PCR primer used in conjunction with SEQ ID NO: 6044 to amplify a rice gene promoter
tacaagaaagctgggtgcggcccgatgcgatcgg

SEQ ID NO: 6046 - DNA, 47 bp, Artificial Sequence
  Artificial PCR primer used in conjunction with SEQ ID NO: 6047 to amplify a rice gene promoter
tacaaaaaagcaggctgtgatatacgcataaggaattatttcctccg

SEQ ID NO: 6047 - DNA, 37 bp, Artificial Sequence
  Artificial PCR primer used in conjunction with SEQ ID NO: 6046 to amplify a rice gene promoter
tacaagaaagctgggtgagcacgtggtgcgagggaag

SEQ ID NO: 6048 - DNA, 41 bp, Artificial Sequence
  Artificial PCR primer used in conjunction with SEQ ID NO: 6049 to amplify a rice gene promoter
tacaaaaaagcaggctttcgaaatcgtgcattcaacaaagc

SEQ ID NO: 6049 - DNA, 41 bp, Artificial Sequence
  Artificial PCR primer used in conjunction with SEQ ID NO: 6048 to amplify a rice gene promoter
tacaagaaagctgggtgctagcaagggagaggtagcggaag

SEQ ID NO: 6050 - DNA, 40 bp, Artificial Sequence
  Artificial PCR primer used in conjunction with SEQ ID NO: 6051 to amplify a rice gene promoter
tacaaaaaagcaggctctgtcaccgtcttgacccgacttc

SEQ ID NO: 6051 - DNA, 41 bp, Artificial Sequence
  Artificial PCR primer used in conjunction with SEQ ID NO: 6050 to amplify a rice gene promoter
tacaagaaagctgggtgcgaactagatggcgagatttggtc

SEQ ID NO: 6052 - DNA, 41 bp, Artificial Sequence
  Artificial PCR primer used in conjunction with SEQ ID NO: 6053 to amplify a rice gene promoter
tacaaaaaagcaggctgtacccatgccttgcaacaatgtcc

SEQ ID NO: 6053 - DNA, 40 bp, Artificial Sequence
  Artificial PCR primer used in conjunction with SEQ ID NO: 6052 to amplify a rice gene promoter
tacaagaaagctgggtaagtcgcgccacattgctgtcatc

SEQ ID NO: 6054 - DNA, 41 bp, Artificial Sequence
  Artificial PCR primer used in conjunction with SEQ ID NO: 6055 to amplify a rice gene promoter
tacaaaaaagcaggctgcaaggtggacaatgtgtggagttc

SEQ ID NO: 6055 - DNA, 43 bp, Artificial Sequence
  Artificial PCR primer used in conjunction with SEQ ID NO: 6054 to amplify a rice gene promoter
tacaagaaagctgggtcagaagaggagtgatggagaagaaggc

SEQ ID NO: 6056 - DNA, 41 bp, Artificial Sequence
  Artificial PCR primer used in conjunction with SEQ ID NO: 6057 to amplify a rice gene promoter
tacaaaaaagcaggctgggacccatagtcactgggtgtttg

SEQ ID NO: 6057 - DNA, 37 bp, Artificial Sequence
  Artificial PCR primer used in conjunction with SEQ ID NO: 6056 to amplify a rice gene promoter
tacaagaaagctgggtgcagtcccctcctcttgcagc

SEQ ID NO: 6058 - DNA, 41 bp, Artificial Sequence
  Artificial PCR primer used in conjunction with SEQ ID NO: 6059 to amplify a rice gene promoter
tacaaaaaagcaggcttggaggaacgaagcagtagcacaag

SEQ ID NO: 6059 - DNA, 41 bp, Artificial Sequence
  Artificial PCR primer used in conjunction with SEQ ID NO: 6058 to amplify a rice gene promoter
tacaagaaagctgggttgtcacccaccccaatcaagctaag

SEQ ID NO: 6060 - DNA, 38 bp, Artificial Sequence
  Artificial PCR primer used in conjunction with SEQ ID NO: 6061 to amplify a rice gene promoter
tacaaaaaagcaggctcaagctcaccggcgtcgtactc

SEQ ID NO: 6061 - DNA, 38 bp, Artificial Sequence
  Artificial PCR primer used in conjunction with SEQ ID NO: 6060 to amplify a rice gene promoter
tacaagaaagctgggtccaccgccatcgactcctactg

SEQ ID NO: 6062 - DNA, 42 bp, Artificial Sequence
  Artificial PCR primer used in conjunction with SEQ ID NO: 6063 to amplify a rice gene promoter
tacaaaaaagcaggctcccgtcagtttaaatataggcacccg

SEQ ID NO: 6063 - DNA, 38 bp, Artificial Sequence
  Artificial PCR primer used in conjunction with SEQ ID NO: 6062 to amplify a rice gene promoter
tacaagaaagctgggtgccaggggcaagggtaggagag

SEQ ID NO: 6064 - DNA, 39 bp, Artificial Sequence
  Artificial PCR primer used in conjunction with SEQ ID NO: 6065 to amplify a rice gene promoter
tacaaaaaagcaggctctccaatcctcgtcaatcccatc

SEQ ID NO: 6065 - DNA, 36 bp, Artificial Sequence
  Artificial PCR primer used in conjunction with SEQ ID NO: 6064 to amplify a rice gene promoter
tacaagaaagctgggtgttggactgacatgtggggc

SEQ ID NO: 6066 - DNA, 45 bp, Artificial Sequence
  Artificial PCR primer used in conjunction with SEQ ID NO: 6067 to amplify a rice gene promoter
tacaaaaaagcaggctgtacatgtacctgcatcagaatctagttc

SEQ ID NO: 6067 - DNA, 40 bp, Artificial Sequence
  Artificial PCR primer used in conjunction with SEQ ID NO: 6066 to amplify a rice gene promoter
tacaagaaagctgggtgccacgtacgttacgatcagtaac

SEQ ID NO: 6068 - DNA, 24 bp, Artificial Sequence
  Artificial PCR primer used in conjunction with SEQ ID NO: 6069 to amplify a rice gene promoter
cacccggagaagctcacgcccttg

SEQ ID NO: 6069 - DNA, 22 bp, Artificial Sequence
  Artificial PCR primer used in conjunction with SEQ ID NO: 6068 to amplify a rice gene promoter
gtatgttcgccgtggccatttg

SEQ ID NO: 6070 - DNA, 27 bp, Artificial Sequence
  Artificial PCR primer used in conjunction with SEQ ID NO: 6071 to amplify a rice gene promoter
cacccttgcgtgcaatgatagatggtg

SEQ ID NO: 6071 - DNA, 21 bp, Artificial Sequence
  Artificial PCR primer used in conjunction with SEQ ID NO: 6070 to amplify a rice gene promoter
gaaatcgaaccggacccgaac

SEQ ID NO: 6072 - DNA, 26 bp, Artificial Sequence
  Artificial PCR primer used in conjunction with SEQ ID NO: 6073 to amplify a rice gene promoter
caccagacactgcagagatcctcttg

SEQ ID NO: 6073 - DNA, 26 bp, Artificial Sequence
  Artificial PCR primer used in conjunction with SEQ ID NO: 6072 to amplify a rice gene promoter
ccatgagatagatgtggatgaggtcc

SEQ ID NO: 6074 - DNA, 27 bp, Artificial Sequence
  Artificial PCR primer used in conjunction with SEQ ID NO: 6075 to amplify a rice gene promoter
caccagacgagtctagtgtccatatag

SEQ ID NO: 6075 - DNA, 26 bp, Artificial Sequence
  Artificial PCR primer used in conjunction with SEQ ID NO: 6074 to amplify a rice gene promoter
cacccatcacaagccaatgcagaagc

SEQ ID NO: 6076 - DNA, 26 bp, Artificial Sequence
  Artificial PCR primer used in conjunction with SEQ ID NO: 6077 to amplify a rice gene promoter
cacctccggtgtacttcgagatagtc

SEQ ID NO: 6077 - DNA, 26 bp, Artificial Sequence
  Artificial PCR primer used in conjunction with SEQ ID NO: 6076 to amplify a rice gene promoter
gacaaaggagtaggatcaatgcatgc

SEQ ID NO: 6078 - DNA, 1854 bp, Oryza sp.
  misc_feature (1)..(1854): RA1
gataacgtagttacaatgcaattacacaatgcagttatagtagggtgcaactggagtataactaacatgtaactcaattaattttttaaaaacatgcaacagatctaagtggctagcacgcacggcttgtgggatggatatcctaggttcaagcccttgcaaggacacaccttaattctcgcgcagatttttttttccaaatctcgcacgaatcatggcgtggatcgcacggccagaaaatcaaaagttttcagcctccaaaactgtcgacggctagctagcaaaaccgtaaaactaaacttactgtaaaggagaaacacggaatctcgcggaacttgatcacatagggaaccctagctctctactatataattagccaagccatcatggagagagatcaaaatctctgccaaatttatttcttccttcccaaatgaggggtgcagtccaccccccctccaccccatgtggtacaatgtgcagtggcagtcccccatcaaggcaagcaagcaaccatagtgatcaatatgctagctgcacatatacctctctctctctctctctctctctctctctcttagctagctagcaacaaacaagggagctagggttttcttggctctgttgccataagcagcaagtgtaccctgtccctggagagctcctcatggccatggccaacctaacaaacctagctgccaagatcggcaaggaggaggaaaccgggtgggcccacactgtcagagggtggttacaagtccacacacatgttgctttccatggtgccttgtgaggggcatgcagagagttgctatagctacatacaccttcctcgcaattgcatgtagtgttcatgattttataccatgcccatgtatatatagctgcactgtgctctgatgagtaatactgttgcattatattgcatgagctacatacactgatatctctgaacttttgtgtgcgtgatatatgcactgttgcagtgtgtgttttgtgtcacaagctaggctcgtgtatttgtgcagagatcgaccagagagtatatgctagtgcatcatcattgcatgctgcaagtacacacatggatatgcacactgatctgatcatcatcatcatgaagtcatgcttatgtctgcatccgtttcttgctttgactcactatctgatcctaattacacactgatgcaggggtaaatgtaaaactagactagctagcatattagttacagttaaaaatgtagtttgttgctttctggatatttactactccctccatctacttttgatttgatttggagtagtacactgatttgatttgcaggagtagtagtgtgagagtgtgtgacagagagaaagcattgtgtgttgcacattactacaagctctctctcctatatatgtctctccttctgcacctcctgccttagcctttgaagcaagcttagcacttcacaaggtatgtacatagcacattactactcctgccctatctatctaccctgttcatgagtaattcaagaaaaaaaaaaggacaccttttctagctagttcttcatcctttcgcagcaaagagtttttacatctctagctactagttgttctcttctctacatgaaattttttctacttctgattgcaccctttacatagctgtggggggaaatccaatttgagcacccatgccttatgttgattttaacaaaattcgtccatgtatcgatatgttcataacttggccatttctgttcttcttcttcttcttcttcttcttcagtttcctcttgtgcagaagaaggagaaacaaaagaacacagaaattaaattaaactcgatcaggaaggtatagcaggc

SEQ ID NO: 6079 - DNA, 1923 bp, Oryza sp.
  misc_feature (1)..(1923): RC17
gcgcaaaacggtataggtctgaacgctatgaatccctgagtggtcccagttaagttaggttggtctgattatctactgctactatgtcaaaattttcgattttgttattggtaaattttggtaaaataagtatcatttggtgcatgcacatctcctactttactgtaagttcgtaactggtgagtttagtccacatcagtattaaaagttgagggcagtccacatccatcaattagcatgtggtagagatggcccatggttgatgagctagattgcgcgctccaactgtaacttctataataaagaaatttaaaatgtttgtaatgctacctagcactaaaatctgttggtgaattaactataggtacatatattatattactatacctctccatggagtgagttccaaaattaatctcataattaagtaagagcaaaacgaggaattcctttatattttgtcctcaatgttttttcttcaattgttaagaggataatatcttatcctcttaataattaaagaaaaccgttcagaaaaagataagataaagctcatcgtgttagcttattatgtaccttttattaatctctactattataaaaattaaagatgtttttaccgatactttggtatgccatcgtgtatgagtcggtttttaagttcgttcactttaataaatacatatctgtatttgagacgggttttaagttcgttcgtttttagaaacacagaaggagtcatataagaaatctcttaaaaaactcgcttgctaacttgagatgatcggactcctaattatagctaatgattttctatatatatatccaagctgatttccacagtgaattttaccttaactaaactatataacaataataatattattagaatagctttcacccgttgcaatgcatgggcattttttatctattatctcttaatgttcagaaaaatctttgcattttcacctgcatatatttgttctaattagttcaaccgaattaaaaaatttatcctcaaatagtagggacatatatacctttccaacaaggagaggaaacctattcaatcaaataaaagaattgtttgaaccacttttccccgaaactgactttcaaactactagaaacttatgacaaagaggtttccagaaatggtcgtttttttttcttatatcaagattattgtaccaatgtgagatgaattctttggtgttatcaatatttttgtaacgttggaagtattccttccgtaaaagcaacttgatttttatctatgcaactttacaacttatcatttgggatgaaggaagtaggatattggtgaggtatttactctattaccgtataaacattttggataaacccatgttgctctcccttcctatcgtcttattcaactctacattttgttaagaagtgtgtggacgtatgagcatgagtatgtactacctcatgacgagtggtttcaatttcacccttttgttgagaagtgtatgaacatgctagcctaaatactccgtaaaattcctaaccaaagctaaatactccctaccatttattttaaaattttaaaaaacccacccttttgtttgtatatagtcagtgagtatgttcgatcggccacttggttgtaatactgcttgtataacgttacatactcggcaatacaccccggctgtgttaatttggcagcgtgtgctgttcacttgtacattactcatcaagtggcggacaagttgtagaaatgtagaggccaaaccatcaaaaagccaaactactccacacaagacaccgtatgcacaaacgatcaacattcccatcatgcccatccagcgtgacatcaaaagcggcgtcctaggaagccagccaccattccatgccttcccctgccgattccaccccctgctactaccagtctct

SEQ ID NO: 6080 - DNA, 1992 bp, Oryza sp.
  misc_feature (1)..(1992): RC22
ggagcatgtactctttataactaactttacatgtcatcctctacttatcttctcttcctctcttcctacttctctcgatcttgctcctcgtagccccatcattattattgtcgccactttcctatcaccttacatgatttgctcgtccttgtaaaaaatccctttgccacaagctgatgtcgttgcagccatcgacaagtcaaatagccaatgtcgtctataagctcaccggtactacccttcatcagagtttgtgcatttttcactggatcgcatagagatggaatgctgagctagagcgagaggtggctatagcttcaccctcgatgtgtccatgaggtcgccgccggcgtgaggtggctagatctagtcgttgcaacaccactagatctaaaggttgtgtggccatgaatcgagttagcaagggcgaaacaatatagggtattggtcgcctcaagctcatgggaaggggtgtgtcatttttaccgttgccttgagccatccaaatcttagatacgtgagatcatcttcgtcatttcggtggcctactaccggaacatggttgttgcatatattccatcggcacaatgacatggagccccaccatgcaacacaaggtaggtgttaagaggctgagctgtagacttgcggtgcatgtcttgccagaaagctcaatggagccagtggacttagcatgtgttatttggcggtttcatgaaagcacagcacacacattagcgtgtttagtaaggaaaaaatatacatgtccaactgaaccaattctctagcttgtgttgaggatgtgcatgtgatatgtatgttaagtgttcgactattgtatttgaaagaaaacaacataaccaatgaatcgtgttcctaaacttcccatttgtttgttcttctttagcctttttggcaaacggtggcacaaaatggtttgtgtggattgaaagcattactagtgactggattaatgtactatggtattaaacaaaccactaaagaaaactatcgagttgatatttaactcttaaaagttaaccaaaatgtaggactagttccaaacagcaccaccaaccaataattaaattataaaagaagggagcatatatattaacataatacaaatgttcatccaaaattattcgtttgtctatctagatttgactaaattaagtagttgtttaactagtatatcaggattcattacttgagtggtggtagaaatatactgtgcgcagggaaatcaaaggccataaagaccacgatgtttttggtagcttggaaaatctagagtgaacacaatagacaagtcttcaaccaacaagagagagagagagagagaggaaggtgtctcaaattgttgaaagaaatcaacatttgagttatgtgtagagtgaaagacttagcgagaacatctagcttaacatagccgtgtagtttatgaagactccacagtcatatttttttcttatgtttttgtcgactgtaagtattgtttgtactgaaatattgggcctgttcactttgatgctattttcaaccttaccaaattttggtaaaattaccaaaaaaatatctacatttagtttgctgctaaattttggtaactatataagaaatcctaccaaaattttgacaactatgccaaaatttttggcaatgccaaatttcggtaagttttttttcatcaaagtgaacatgcccattgttactcattcctaatactataggaacagcaatatttagaaaaaaaaacagtcatatttgtttgaaaaacttttttctcagctttgaagaggttactttgagaacaagcatgagaaggccacagctgtcattttcagtctcggcctaaagcccaagaaagaaaaaggcctaaaccccttaggcccttaacgccaccaagagtccaacaccaagccgcaccagatctccctctcccgaaccccagcgccgccgccgccgccgccgccgatcgcatcgggccgc

SEQ ID NO: 6081 - DNA, 2050 bp, Orzya sp.
  misc_feature (1)..(2050): RC9
gcatcctcaacatactgaaacaatgtactaactactagcaacagatcaatatgcagcaattccctggatatatgaccaaagcataagaagggacatggactctgaatatttgcatcctcttgtgggctctaaccttaattctgaactatacaggtggtgcacatggatgagaagggatggaacaggaaattgccgcggaatagggttcaaaattaccggtgtagaagacccatttgacggggcgtttggtgagggtgtcctcgtagtaggtgatgaagtcggccttggcccagacgtggcagtcgaagccgtcggcggggtggcggccgaggtagacggagccagggacgagccagtttgggggcaggatgccgacgccgacggcggcggagcggcaggcgcggcgggccggggtgtagaagaaggaggtgccgttgttccactcgttgtcgtagaagggctcgtcggcggcgagctggtagcggatgacgtggaggttgcggccccccggccagtcgtaccacaggtccgccagcgacaggttgccgtggaactccatcaggagcttcgcgtggaactgggccggccatggcgtcggcgtcggcgtcggctccgatccgtcgccggcgacgacgaggaacaaggccgccgcgaggaggagaggggccgccgtcttctccatcttgtgcaagtggctgcgctgctgcgtgggagtgagatggcgtagtacggtttcgagggcttgagtgaaattgtgtgattttccaagggtgattatgcaaaaattcgtccatttttagtacggtttgggcccattaacaaatggactttgctttgtccaattgctacaaattgagcctactttcttttcgtttttgctgctttaacaagtagaaataggcccaagtggcagagttacctacctttgctaattttggactccaagcacacaattagtactcatccgcattgtgctaattcaggttattgagaggggaagaaagtggttatacgagatcgatggaggacgcagcagctaacggtcgctatacgatggaaatgagattgtaccggacatattgtgcatatatacaaaaagtataggagtatgttccagacgatggcaacttgacctctttaattcaaagctagcctcaaacgtacttaactattcatgctttgacgtcaaggcaagggtcgagtagtaagtaacacaggctcaaaaggcaggctatcttaagctacctatacgttttgagtgtagtatacgagccgatcgatcgatcgatcgaccactgtaccgcactgcacgcgccaaattgaaaatcggattagtggctcaaatcaaaaactaaagttagtctgaactttgtctagtgtgcaaaatcttttgacattaattaatcaattggtaggttttgtgcgttgtgtcttgtgtgatttccacacttggttgacgccgacgtcgttgtaaagtttgcacgcggcaactgggcgtggtctctgaacgaaccgtcaattcattcatggaatgaatttgatggaaacatatcccgactttgtgcagtctgtaattgtgctatgttagtgccacaaagtcgatatagcacaactacaaattgcacaaaatcgacatgggacgactgcagattgcacaaagttagaggagtttctttcgaatttgatatatggtccgtccaaaaaaaatcatgggattggcgcctgcctgaatccatggtgggtcgttggccaactcctccatttctcacggcgccggtcgccgccccggccctacttcccttcacgcctccactgacctcgccggccggccaccaccaccgcccgcgcgccacacctataaaacctcacctcctccacctccatggctcaccaccacgtacagcaaacaccaactcagctagctatactctactcatcttctctgccagctgctactacaccaaccagagctaatcaagtaacaatggcgggaagaggcagtgccatggcggcggttggtgtgctggtgctcctctgcgtgctcctccac

SEQ ID NO: 6082 - DNA, 1744 bp, Oryza sp.
  misc_feature (1)..(1744): REM13-1573
tttccatccttcccgtcacactttccgtccttcccgtcgctctttccaggaggctgagggcacggaggctggcgttgtgggcggcagacggcggagccgccgggtcaaggaggcggagcggcggatttgccggcggacggagacgacgggtcgaggaggcggagcggtggagttgccggccggcgtcgtcctccgctcctcgctgccgacccgctcctcacccgctacggcgccgtcgtggtggacgacgcgcacgacgggatggctctcaccggcgtcattctcagttagtcggcccattcatcttgaagaaacagcaaccagtcatatccaatttccatcccagtccgtcgtcccctagctgccggcatgccagccacaagcaaccctcgtcatgctgcatcaaatagcaacctcgtcgtcgatctgcatcatcaagcaacaacagccgtttcggcatctagtggttgacattcacccagcagaagcccggccggatttggcgctggatgcggtgctcgttgaagccgcccgtcacgtacggcgcctcttcccgtccccatcgcatcgctcatcctcaccgtctcctcgtcctcatcgtcaattgcggtaacctcatccaagtcatcgcccgtcgtggcccatcgtctacaagcagcaacaagccagcttcattccggcggtggcggcgggctgaaccacggtggccgtggctttgtgctgctgatgctgcgccgcaagctgctctcaaccacgcgtcccctcccatggaactcgtcgacagactgcaggcacttggccgtgtcctcctcggcagacggcagaccaggcacttggtcgaggtcctcgagtccgcaaaaacgcgcgtgccggtcttgacggcggcgccgcggcggagtgggccggcgcgggacgagttgaggaggccgaagtcgaggccagagaccatcccccgagaggcgctggtcgtcgagttcggcggtgctttcaacggcgaagtagaaagacggcacgtagttaggaaattaacgggggaaggacggaacatgcgacggggtggtatggatccaatttaccaaaattttagtggcacctagccgatatcacgaatagtaatagcgttttattaatttgccacatttgcagtggcatggatgcaattaaccccattttcaatcgcgcgtccctcaagcggtaaaacaggactccgtaggtagtcaaacggcctggaaactaaccagtgcagaatcgcaggataccataacctgaataaatcatacacacaaaccggaaaaaagaataaagaaagaaagaggataaatggtagccaatttgtgttagggcgcagcagccagagccgaaagcttctgaagctgatgcgatcaaacctcaaaagaccatgggcagccagcacggaagttacaaaccgaagccgcgcggcgcgcatacgcatcagaaaggcgcgcaataacggaccacccatacggcggccgcgctctgttcgcggcgtccctgcgcctgcatcgcacgccatccaaggctgcatagcacgacgcatacatatctcacgcgccctttttatctgcttataaatgagatagcccacatagcagcgctgccgtttctcctcttctctcgttgggggcaaccgaacttatccaacaacgatccatccattggccaagtggctgccgtgctgcacctataaattcacatgcaccggcatgccactccacacaactca

SEQ ID NO: 6083 - DNA, 1976 bp, Oryza sp.
  misc_feature (1)..(1976): REM7-1567
acataagccatgacacaatccaacaagcgccacaaaagtcaagagagatctatagctacctataatctcgtcgagttccaaattgaggaatctgacgattgctagcagagtactcaatcgaggaatctgatgattgctagccgtcaaccacatgcttgacttttatgccgctatactgtcagactcctccccattgtacttgtgagagattgattttataatggcatctgcttcgaccaacaggagtagcgctattacccgtcaaagggagcctgaacctatacaaaaatatgtctcccgtctattttaccacaatcttgcatatgccatggtatcaacatcctcaatacattacaaatatcatagtcgggtacagtctgttgatagaaagggggagggggattatcttgttagtagcttttaatgttgactcccttagcactagaattagctttcagatgtgcatatctaattatggtttcaatccaacggcataaaatgtgacaaaccatagttcaccttatgtaaatcaacaacgttccatcaaattagtatagttccttctcaagatcaaaagtaaacgcaaaggacggttacatagctttagtaaaagaaaataagaaaattgctgtggttggcatggggctatagtcatctggactgtgtggaaggccagaaatacagcttacttcaaaaacaagagaattaaagatcctactgaactaatacatgaaggtttttactggatcaattcctgatccattatgcagatatcggaggactagcgaagaatactgcagctggggttggcgctgctaatgagaggttgccgttaaattatactccctccgtattttgaccaacgtttgatcatttgttttattcaaattttttgtataaatatgaaaatatttatgtcatacttaaagaacatttgatgatgaatcaagtcacaataaaagaaataataattgcattttttttaataaaacgaatgatcaaacgttaaacaaaaagtcaacgtcatacattagaacataaagttagtataattcaaagatatggatgaaggtcacaagcaatgcgcttgacgtggtgcaaatctggagttattgagctttccattgcatgtctgtgattgtaccaagtcaatcgacgtttgctgttttctttgcaaatagtcctagactaagttgcttgcagttgcaggattatggtggattggtgacggagttggtgcttatggcctttgttttctgtcaggggagttgtctgctctgcaggtcatataaactctgtaaaagtgtatattggcatttcgtcgatgaaatgggagaggatctcctctcttttttcaataaaaaaaagtaaatgcaaaatatatgtccgttgcaccgatctcctttccaaaccgaaagtttccctgccggcgcttgatccgtcacaccgatgacgcgacgccggtagaggcccggtacctgttcgaacaaccaactgatgtgcggctcctccgcttgcggcttgcctcttatcaacgtatcgccgtttccgtcatgcgtgatcggtgatcgatcaccgagagagaccggacgacgagtcgagagagctcgcgcgcgcctcgatcggcgcggcggtgactcgagcagggcctgaagtagctgcacggctcaaggcggcactccatcaccggacaccggggtccagactactcgtttccgttggagaaataaccacctttatccatgttgcttatccgtgaattgcaacagcattgattgttcgcgtttaattcgcctcggccatgtaacctccgacctgatcctcttggacactataaatagaggccagttcaggcaatgcaagagcagagaagcagagtacagcaggcagctcttcttctctttgcgaaggttggctacttggccagccattaggaaacaagttagtttggagaagaagcagagttgagactgcat

SEQ ID NO: 6084 - DNA, 1905 bp, Oryza sp.
  misc_feature (1)..(1905): REN5-549
ataacggtgtgtaaaagtgtgcaaaaaatatatcccatattgctcaaatgcattagtcagatttaaaccatgtgagatatctaagttttgaatgtctattacttttgaatcataaattgtatttttcatctatttgtatctttttttaataattaaatgttgactacccccgtgaaatctcatcgtatttctatttttttagtgtgacgtatatatacggtagtcataattttctatgatgaattacgtcacctatgattagtcgattacgtttgctatcaaataatacattaattattgattttttacacaaattggtagagaaattagttacatatggttgtatatccaatatcttttatagcaaagttttctctcttttccgatagaacttcaagagtcagatgtcataggtagcataaaacccaatctcaagtaggtaattttataaatggcataattaaattcgtcatgcaatgttaacggagagaacatagacaaatcgtacttttgaaatgtggcaggtattatttcataagtatacaactaagtttctcaaatgcaacctatgatacatgcatgcgcgcctagttatccttaaatgtgaagttgtagttttatttttttttcaagtcaaagatcacagttaccgtggcttaccgttcgtgcagtaacatgactttaccatgggatttgaaaattcttaatccaaactttcctaaagataaaattcgtatggtttttgacggtcactgcacaattatcacgtttaccgtcgtcttaccatcgaggagttgtaacctccccggtgatggtttgggaaaccttgctcataggcattatagccgtatacaagtttatttcctaactttattggaagataaatttgcataggcacatatacttcttcagtttcaaaattcgctttgatatgcccttattgaacatatgggatatatggaagttaaatacccttccattacctgggcagtgctttgatttgtctgtttactcgttatggtaggtaattaacagaatacgtttggttggcaccgattaaataaactttcatgcaacaactccaaatatgatatcccacgtcacatccatatgctcgcatagcgtgcagtttatttaacgataggaaatatacaatatcaaggtgttaaaaataaaatggaaacaattcaattaactattgtcaggtactattagaccatatgacgtcgtgggagtaagctactaggttatagcacacgttctattaaaaatatatgttgcccaataacatcaaagataatttaagtaaaaaaaccatagtagagagaacatgaagtggtaaaaaaaccattgtcacgggttttggttagtcatatttgattactcgtaaatatttttactaaaataaaagtgattgagtttgaatgtaagcaacttctaacgatagtgcattctaaagtgctaatggacaatgaattatggccagaattgagttcacgacaatttcgaggttttgataaattgatttaaaacgctttataagaagtgtcaatgaaaaaaaagctttcgtaaaatcgtgctgtgataaattaggaagcttttcgaggcggaagcggataagttaaataaaaaagtcaataaattaatttaaagacgttttctaaagtaatgacacgaaaaaggattatataaaaaacgtgccgtgacaagtttagaaaacatgccgtgataaatttaaactagaaaggtagccacggagggagtactctccttcagccagataaaacgtgacgatatataaacggagtgagtagattaacttagttagctctcaccaagtgttatgttaaaaaaagaaaattaaatacaattacaactgtgaacttgacgagtgacacatttaat

SEQ ID NO: 6085 - DNA, 1966 bp, Oryza sp.
  misc_feature (1)..(1966): RTG1-1580
  misc_feature (218)..(218): n = any nucleotide
  misc_feature (251)..(251): n = any nucleotide
  misc_feature (349)..(349): n = any nucleotide
  misc_feature (357)..(357): n = any nucleotide
ttgggaacacaatggatggtggacagaaccgtcgctgtttaatgaacaatagaattaaaacttgatcagtttatactaggtcttaggtttgtgaaatgatatttgaaaactcagctttacgcaaagtaaccatagccactccttgtattatcctgtacattattgcattttctgtggtggcttgctgagtacttttgtactcattgttgctcatatgnatatcttttagcagagtattgaagagaagcccntgttagtacgcttgcgtacctaacaagatgatcggagtgcggttctgttctaggtctcgttccccagtcgactgcttgtggcatgtcaactgagcccntgtattantttgtcttccactgttgtttctctgatagttgttggcctgcctggccctaatgtaagtatttaactctcttagcctgaattcattcgtgatatgttgtgattcggctatgtatgtgtgtaccaactactgatccagggattggtactgataaacacagaagatttccgatttacaaaatcgggggtcgacatgccagatctggcggaggggagggccccgccatgttgccgcctcccttcccgctggatctggcggagaggagggtgccgccgcttccgggccgcttcctcccctcccgtcggctctggcataggggagcacgccgccgtgctgccgctggaccaccgcctcccctcccatcggatctggcagaggggagggccccgccatggtggatggaggaggaggagaggagtgctgccactgttgtggatggaagaggaggagagaggagaaggaagaaatggagagaaagaaggaagaagaagagaggaggaagtggattgcgggtgcgggagatagagttcgagagagagggaggggaggaagagataaggatgggagtagatagggtggctcagctcggctcggttagttcggcagataggtgtcggttttaaaaaaaccggcacttataatatattataggtctcggtttttaattaaccgacacctataatatattacagatgccggttttttcttaaaaaccgacacccatagtataagtgtcgatttttctttagaaccaacacctatagttgtttaaaggtgtcggtttttttatgttttcatcccggttgaggtttgaaaaacattatatataggtgccagttttagcacgtccggtacctatagtgccgatatatatgtccctttttgtagtagtgatccctcggaataatagtaaccaaacaatattcttattctgcaggtgtgaacaaattaaacttagttttgtcttgatcatctgccaactattctttttaaggttaactgtcgactactcgcatttctcatatacccatcctcctcgtggaaaacagttctcctcctagactatgtttagttcctaaaaaaagttgaaagtttagggaaagtttagtagtttggaaaaaaaattgaaagttcatgtgtgtaggagagatttggatgtgatgtgatggaaagctggaagttgggggtgaactaaacacggccctagtgttctctcgttccccaaaattaatataaatatatttactctttctacacatttacatcaacacaattcgcaatatgcgaagatcgtttcatattgccttccacgtgtaccgtaaaaggggagcaaatacagtcgacagtggatggaggggaatagctctggttttcccaacagccaaccaccagctgctaagctagctcccaatcgtattgaatgaacgtatggacacatgcaccgtttaaacaccacaaacccatccttgctttgttaattgctcgatctcttgcagctgcgtgcaccgcatctgtgcatgcatccacactagcaactctacctatttaagcccctgcattcccgcgtattctcctcatccatctcatcagcaacgaaccaattcacaccga

SEQ ID NO: 6086 - DNA, 1948 bp, Oryza sp.
  misc_feature (1)..(1948): RR1-1577
  misc_feature (543)..(543): n = any nucleotide
  misc_feature (672)..(672): n = any nucleotide
  misc_feature (1045)..(1045): n = any nucleotide
  misc_feature (1047)..(1047): n = any nucleotide
  misc_feature (1068)..(1068): n = any nucleotide
  misc_feature (1102)..(1102): n = any nucleotide
  misc_feature (1501)..(1501): n = any nucleotide
  misc_feature (1902)..(1902): n = any nucleotide
gtttctcgcgcccactatcttgccccctcgattctcgcgcccactcttccacttatcccattcgcccgtttacggtgcatgaggtggatatgcggctgtggcagtcgagatggaacatctcgtgcgcgcgttaattacgctcgccgaccgaagcgccatcaccatatctccaggcaaaacgaaccggcacgtcccgattcgcgcgtaatgtggcagtcttgaagagaccgttcattattgacagccgagtaaccattgccgatgtgcgtgatttgcgactgttgggtttctgcccaactgtggaaaccggtcccacctgtcaccaggccttaggaagtggcgtcacgcccgaccgcttccctcgaggagggtaatcgcctcggcataacgccgggggctactgtcgatgacatgggaccgggagtatcgtgactagaggcttgaggtagacacaatcgcccacgtggcctggcaccctcggggggggggggctttgggcccaaggttggtgttttggcctcctcttgtctccccgaggggttngaccgttcctgccttggccccgagggctgggcgccccgaccccttgtggattttgcgccgcgtgtatgggtttggtgagcacagtggcgctcacctaactgcatttattgcggtttggacgaacgcgtnacgccgcgtgtaacgcagtgcagcgcgctcgtttatccggtctgtgaccagtcacagaccggtcagatcgtgggtcaggtggcgacaggcggtctgacgcacgcctcgccccgtccagtcaggacgagagtctccaagcactcgtccctagccggagccggcgtgttagctcctggagatgacacgttggttccggtcagatatataccaggcttcatcctaaccattacaggcaagatgttgtatgaagaagggcgaacatgcagattgttaaactgacacgtgatggacaagaatgaccgattggtgaccggtctgacaatggtcatgtcgtcagcagacagccatctcccacgtcgcgcctgcttccggngnaagtggaggtaggtatgggcngtcccgtcagaaggtgattcggatggcagcgatncaaatctccgtccattaatgaagagaagtcaagttgaaagaaagggagggagagatggtgcatgtgggatccccttgggatataaaaggaggaccttgcccacttagaaaggagaggagaaagcaatcccagaagaatcgggggctgactggcactttgtagcttcttcatacgcgaatccaccaaaacacaggagtagggtattacgcttctcagcggcccgaacctgtatacatcgcccgtgtcttgtgtgtttccgctcttgcgaaccttccacagattgggagcttagaacctcacccagggcccccggccgaactggcaaaggggggcctgcgcggtctcccggtgaggagccccacgctccgtcagttctaaattacccgatgagaaagggangggggggggaaaatctgccttgtttatttacgatccaacggatttggtcgacaccgatgaggtgtcttaccagttaccacgagctagattatagtactaattacttgaggattcggttcctaattttttacccgatcgacttcgccatggaaaattttttattcgggggagaatatccaccctgtttcgctcctaattaagataggaattgttacgattagcaacctaattcagatcagaattgttagttagcggcgttggatccctcacctcatcccatcccaattcccaaacccaaactcctcttccagtcgccgacccaaacacgcatccgccgcctataaatcccacccgcatcgagcctatcaagcccaaaaaaccacaaacccaacgaagaaggnaaaaaaaaggaggaaaagaaaagaggaggaaagcgaagaggttgga

SEQ ID NO: 6087 - DNA, 1994 bp, Oryza sp.
  misc_feature (1)..(1994): RS13
cctcatcccaacaatgtgtacccccaagcagaccatcaggccgagcaaaggtaacaaggccaacagagaagcgcacagccatgaggattttcttgtggtgcagcatgtttagttgacaaatttgccctgcataacagcgttgttaactacttcaaggtgaaacagaatgcactcggtggccagccacagcctatggtcttatcacctattaatcgtagcaggcaaggggtgacgtcaaaagaaagttttgcaatttgctttcatagtttcattccattttttcgataatttcaaacgaaaaattaagttgttttgtctttttttttccttgagatgctgatgttggacgagtagttctccaattttggccacctattggttgtgattttaatcttaacttcttcaggacactgcgctgataagtatcgtcattgggaattcccattttggcaagtagttttataatttaccgctaagttttcgttcttatatcactcgttcatgttaatgtagatactgaaatcaatggttttactattgtttaccataatgttctttgataaaacatgataggtcgtacgtatatcattttcgaacatggtagtatattgctactatagtggtgcaccaccctctgttttgctctagcttcgccactgaccacaatctgcgaacatggtgacgcttctggtgtagcagcatccaccctccatgagactgctctagtcacgcatgtgctggtgccgcccgtcatctcctatggcttggttcaaccaaaacttcgtccttgcagccaaagatgacgaaatctctatcttcatctttaaaagtagtgctctggtgttatgccactccgtacaacaaaatataaaaatatcattttttttctacaatgatgattgttaattacttctgttataaatattgtttgaaagaccagcaatattgtcaatatccaactttcaagctagcaaaatgtatgcatatatttttttatgaattacctggcaaacctatctctagttgtgtcatatacctatagtcccatagtgtgacttttggatgtacatcgttaatctttagaaaaatataatgcgacatctcagtactatttcggttggtcacaagaaaatcatattattatatgtactagatttttcaattatacaaagaaaataagtagtcaaagttgatttttgtaaattgtgccaattttaaaaaatgatacattttcatgactggagggagtatacttgcgacagtttagcaataccaaacaagaccaacaattcaatgcacttgaccaagtatttgaacccaatacactttgtatgaagcaagcactttaaactaatacccacttcagctatttcagatgtctagtcaaatggccagcaaacgttaaatgatagtgtaattatatttatattagtacctcatcagtgtcttgaagtccagaaaaaaagagggtgagtccaaggtatacctccatccgaatgatgccatgcctgaaaaccttcaacaccgtgtgaattatggtgagagtaatttcgccctacgcaaattatgccagtaacgttctctatgcattcaaggcatccatatatgtagcattcatgtgagcaacacattttttccatatcatctatgttaaaataaagcagtatgaaagattcatcaagaaaataaggcataagccaacttccaaacttgggagtgcttatctggttatctaccatccatacgtaatcgcctagaacttcaagccaagcacatcatcagttgcacactcttttaataaagtacatatgacaaacaacacacctaccttaagttttttggatgcagtcatgttacacctttcaaccctcttctatgttctaacagccaacttcgtttttgcatcacaggctataaaaaggggtggcatccatagctgaagggacacacctagaaaatttaatagaactttacaaattgagtgttatagtgag

SEQ ID NO: 6088 - DNA, 1875 bp, Oryza sp.
  misc_feature (1)..(1875): RS15
agacaaggggaataatggcgagaggaaggaagcaaatctcttcctcggcgactttatacccttgccaacgctgtgcccagctcctcgtttctcgcgcccactatcttgccccctcgtttctcgcgcccacgcttccactaatcccattcgcccgtttgcggtgcatgaggtggatatgcggctgtggcagtcgagatggaacatctcgtgcgcgagttaattacgctcgccgaccgaagcgccatcatcatatctccaggaaaaacgaaccggcttgtcccgatttttagaccggccccacctgtcaccaggccttaggaagtggcgtcacgcccgaccgcttccctcgaggagggcgatcgccctggcataacgccgggggctactgtcggtgacatgggaccgggagtatcatgacttagagacttgaggcagacacgatcacccacgtggcctaaccccctcgggggggtcgggcccgagggtgatacggccgcccttctctttgtctccccgaggggtcggaccgctaccgcctcggccccgagggccgaggcgccccgaccccttgtgggttttgcgccgcgtgtatggggtaggtgagcatagcggggctcacctaaccacatttattgcggtttggacgagcgcgtcacgccgcatgtaacgcagtgcagcgcgctcgtttatccggtctgtgaccggtcacagaccagtcagatcgtgggttaggtggcgacaggcggtctgacacacgcctcgccccatcccgtcaggacgagagcctccaagcactcgtccctagccggaaccggcgtgttagctcctggagatggcacgttggttccggtcagatatatgccaggcttcatcctaaccattacaggcaagatattgtatgaagaagggcgaacatgcagattgttaaactgacacgtggtggacaagaatgaccgatttgtgaccggtctgacaatggtcatgtcgtcagcagacagccatgttcccacgtcgcgcctgcttccggcggaagtggaggtaggtatgggccgtcccatcagaaggtcattcggacggcagccatacaaatctccgtccattaatgaagagaagtcaagtaagaaagagagggagagatggtgcatgtggtatccccttgagatataaaaggaggaccttgcccacttagagaaggaaagagggaaaaaacgatcccagaacgatcgggggctgactcgcactttgtagcttcttcatacacagatccaccaaaacacaggagtagggtattacgcttctcagcggcccgaacctgtatacatcgcccgtgtcttgtgtgatttcactctcgcgaaccttccacacacagactaggagcttagaatctcacccagggcccccggccgaaccggcaaaggggagcctgcgtggtctcccgatgaggagccccacgctccgtcagatgtgatagaaaagttgtgtctatataaaaggcttggtgtgatggaaagttggaagtttggaaaaaaactttggaactaaacaaggccttattcttcaaacttccaacttttccattacatcaaaacttccatacacacataaacttctaaatttttcttcacattattccaatttcaaccaaacttacaattttgacacgatcaacccaaactatgaaccgcgcactttacttaaagtaaaaagaaaaaaactgtgcgctctccaactaccgcagcaacgtgtcgagcacaggaacacgtgtcacttcagttcttccaattgctggggcccaccactgtttacttctgtacaggcaggtggccatgctgatgacactccacactcctcgacttgcgtagcagcaagccacgc

SEQ ID NO: 6089 - DNA, 1969 bp, Oryza sp.
  misc_feature (1)..(1969): RS25
ttttcgcttcttggcatcctttcacatgatagcaatatcagctgtttataacaagttaggtaccctaggaagttgtagagatgtaatgccatctccctagaaaacttatttttatttttgcccttctgcaggctactccaggggatccagttgtggacaagtatatatccatggggcttggacgtgaagctgtctcatttgctgtgttgaactatggagataatccagcgaaggcatgctttttcccttatttatcttgtgatttatcattaccttctttcaacatatcatcaagaacaaaaaccattgctttgataactcaaaaaggttttcaaaggtcaacaagatagctatatacaatcagtatttgcagaagcactagggtttcttcttctagcaaaacagtgattgccattctgtccagttggtagtttttgtggaattcgattttctacttctcagggagatagaagtgtcttctgccattctaatcgccacgagcatttgtagacagtggaaaaaaaagagagagaaactgacaaggatgaatcctatgtacttgcaggtgaaggagtttgtgaaatcctacaacgctctccacgagatgggcttcacatcctcaaatgttcccgaactgctggccatccacgacaacgaccctgacaaagttatccagcacctgatcggcacatcatagtccagaacaaaactctccacatattcccccatgtataggtccatcttacgctggcaagcgccatacatgtcgcgtttttaatgatggtttcgagtgctagctattgtacgcgtatttccgctacgagtttcatgaactgactattgttgtgcttcccaagcggtttcataaacttaaccttgctttttgtgtcggatatatagagccagtaggtgatgattctgattgctgaaactttggttgctatacgtttgctactcctttttggtcgattcagcaatttcttcccgccgttgttcagtaagctccgaacgctgtgtgctgcacagcagcagccagattcctgtggcaatttgctggctggagctcactactggatagttcatgtccgtggatgacggttggttgtcacttgacatggtggcaaaatcactcgttcaataacgtgacgaacaacttccagatggtaagtaaacacgctaacaattactacctcagtcccaaaataaatgcagccatagttttccacgcccaactttaaccgttcatcttatttaaattttttttaaaaataatttaaaacataagtcataagtaaaatactgttcatattttatcatctcagaacaacaaaaatgctaattataaaaaaaattcaaataagacgaatgatcaaaattgagtgcgaaaactcatgactacacttatttttggacggaggtagtgcacctttttgcatgcctaaagcactggtttgggcatactccgtatgaaacaagcatatgtactgtggtgctgcagacaagtccagaatatgtgtcggccggtgactgttccatccacacactaaggcctaaatgtcattgaagaacttatcgtttgatctagaatcgaggatcactgttcaccacgctatcttttttctgctgaggatgagctttgcatcactggacagcaacaacgagcatgaacaagaacaaacaccacaatccatccccatctccttctctcccccataacgaaatcgttgcaatgctgtctcaatttctctcattaaaagaaaacaaaatcgttgcaatgccgtctcaatttctctcagaaaaagggaaaaaagaaaagaaaagaaaaaagaaaattacatttccagcccaacaccacgatctcccatctccttcctctctcccgctataaaacgacggcatgtcgcgccgtctcccgcctatcgccgatcgaagcttacgagctatctgctcttctctctctctccgccat

SEQ ID NO: 6090 - DNA, 1994 bp, Oryza sp.
  misc_feature (1)..(1994): RS26
cgatgccggcatttgccaattgccgtggagaccttgttaaaggaaattgtaagcagagagatgcgatgggaaggcatattgctgaccctctgcctggagaattaggaggctggtgtgtgataaataaagcgtccgactagttccggcatgtgtttctagaaagattctgtgctgttcgtgttgccattttactctgaccaggcaaatcgttcgtctgttggttgttgtatgtatcccggccattgtggtcgccggcggtgtgcattggcatttcaggtgattttgtacatatgcttcttcttccttagagttggttgatgatgattctcgtctgaacaatgaataggaagtgtagcaagatccttgcgatgcatggggggtgctagcttatgattcttgttgggtacatttcatatgtagaaaatttcacaaattcaataggaacattgtgatatactagtgaagagccttttcactggttgagtaaatttttaacctactgatatatgtatatgaaacatactactagtttttatttatttatttttgtctgaatagtgttcagtcggtttcctttcaatttcttatcttacgcacacatgccgaactcgggttgctatctggcccgtcccaagacgagttctgatcggatccggcccagctcagccaatgccaagctgcagatgatgaacaagaagcatatggccttatcttatcttttcgtttatatttatacttatcagacaaaatttaaaattttaacactagatttaaaactaattttcaggtttttctcattaaaatttgtttttcaatctttgcttttaggtcgttaagaacacgtatataaaaattttattcacaaattacttctcatttacgaatatgccgtttggccaaacaataggcatctgaaggtgcaggtgacgggagcgaacaagttccagggcctccttccattctgctcaagcagcagcagggggaggaagaagtagttaccagcagtttattaattaggccaagtggacaagatcgatggcgcagaaaacgtacccttccacaactgtataatctagattaaattttacaaaaactacatgtattttacattatttataacaaaactataaatttaaaagcttgtttttttcgctgggatggtgaagaatgccgaccgatgtatattaaggaaaagggaaaaactgtacaaacctcctcgggaggaggcacaaatgtagtgcatcaaaagcaccgcctttacaacattaagcaagtttcaaaggctataatctctctaaagctggtgctgcggcaacactcaatgagctaactagccctgctaattttcaagtttcccattcatcacacatgatcgcacacagttgtgtgaccgacgagcttgttttataaaattacaaattcagcgtctccgtttatcacgaaactagacatacttcgtgcaatatatccatcaacacagataatctctatatcggtaatcactaattagtgagcagatcatccatcaacatagataagatctacaattaattcgttacgaatgaccggtttcgtagtggtggtggagagggaggccgccgaccaaaccaaggtcctgcggccgggaaaacgatgtggcttttagtagcaggagtcggcagaaagcatgttggtcggagaagaacatatgccgtacgttttgtacaggtggtgcatccagaagaatctcgatcgcaactagcggggacgtgtgtccagtcctggtgttccgatcgatcgacgtggtgtacatgcatcgcgtccacgtaacagccattcatgcatgatgatcgtctttgtccatcgaccaaagtcgtccaagtgcagcatatatataatcggatgcaactcgagcaaccttacttcccatcatacgcactgcaagcttagcttggtgaggatcgatcgatcggagaagatcatcagattgataattaaagtaagaaaggtcgagg

SEQ ID NO: 6091 - DNA, 1953 bp, Oryza sp.
  misc_feature (1)..(1953): RS3
gtcactgggtggtgtgaatctattcctttgttatggcctgtttgcattgattactttattccttgataccttgggttattataacttgactagttgagctatatatattggttcagctagatattagatatgattgcttagccatgcttagaaacattagcacactattgggattacttatgactcattattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactgttgtgaaacattaaccatgccaaccacaagccagcgtgggcaacggctttaccttttgtataacatggttcattgcggagcactagactgagaagtggcggagataagcccacgggggtcgctggggagtccatgccttgttttataagggggtgattatgatccaggaaaggtgcgctatggtggattgtgttgtgcaaggggtattgtcacagctccttttcgaggtaccgtggtggtattgagggacatggtgatatgatgtggggctgtgtcttgtgggtacagtggtacacctctgatcagagtaaaactattcgaatagccgtgcccgcggttatgggcgggttgagcaatgtttttcgtgattagtctcacacctctcacaataattatagatgttatacctggtaataatttgcttagctcctggtttggagttagatctgtacagccgggtatggttgttcaggatggttgggcctgtgcagcatgggtgtgttgttcagtgttgattaaaatttctgattaattactccactgttttatttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaagatctaggaggagaagacgtttggcttataccccagttgagctgcctgtgggagtggagccggagcttcgctagattttattttccgctgcagttttcttcatggtgaggactaagtgcatcttaagtaagtatttatcgttttagttaatttgatgaatttgtatattaaattgtcagtttgtgtacctcggctgattcctggacgaggattttatgcacaaataagttcggaaattactagtgaattttcgggcgtgacagtagtactcagtcttgctctcttttccctcgcaccagagttgaagttcttctcagttggagccgtctcagagaggttggtttcgtcgctgccgtcaaggtttgcctgtggagtggagtcgcccgctgctgaagtcaagcttcccggtttagctcgcttttatctttcccgctgtatttgtaatcttttatatttttgtaaggcgtgggtctgtatgtcaacaattgttgtttgtgtaccctggctggtcctggacagggatttaatgcacattcagcttagaaattcgggttcgagaatttctgggtgtgacaccatgtcacactgagatataaagtgagtgaggagtcataacattatctatcttgccaaccatcaagtatctgtgatgggcaataaagttactttgacgatggtatacaaggacatctgtggaggcacatcacgtaacttccaaatgacatgactcactctgatcccaatagaatatccaacaaaaacaaacactctagagcaaccgataaggaattcaaagaaaacccatccatcgcatctataaatagacaagcacaatgtaaacccacttcatcattctcacaactcaaacattacagcaaaagcataagaactagaaacccaccaca

SEQ ID NO: 6092 - DNA, 1977 bp, Oryza sp.
  misc_feature (1)..(1977): RS4
agtgaaagagagagctttgggcaggattcgccccaaaaagatggagatgattaattttagttttatcattttaattaaccctgaaattggttgttgttgatttaaaattataggttgctctgaaaatttcagtaaaaattgagggaccaatttagagcatggagaatttaagaaaaatacaccaagccactttgaatttttggatgtattttagtatttgaaatttatttgagacttttattaatttctattattccttttagaaagtgacttttaatttgggatggatctatcaggtgtgacataacgataagagagctccaaattaatttcaagacccaaattaatctcgcgttagatgttttctttcaccttcgagtagacaaagagctctctctgtgtgttccatcttcctttggttttggttctccctgagcagacttgtgtccgttcttctgtttttgcgctgattcagttgttcctcgatcctgaatacttgcacgcatgagtatttgggataagcatgcctccggaacgccatccaccaccagagtacctgcactggtagacatgcggttaagtttgtatcatttgtttcaacatataataagtaaagctaaacatatgtacttctagcttgttgatgtgtaacataagcatggttatatacaagctagtgatgttctcatcagtttggatatttataaaaaacagcaataatgcacacgctcacatatacacatacacttacgtaataatataaatacacacacatacactcattaatacgaatgcacatgcgtatatactctaacccatacggtccaatatatgccttattacacatcactctctagtctctacttgcatggaagcacgctttatctaccaaccagcttgttcagtatgccaccatatatagattatggcacacatatcctccataaatcatcattttagtatatatttgctttctattcttgtatgtcataatgtcattcatcaaacttgtagcttgacaatgtacgtatatatagagggagagatatgagatatgatgaatcgaatttgaagatgctcggcatacccggagcatgtctaggcaagctgttgtccggcctggacatttctataattactaaaacttgaaaaaaaaatccaggaagatattaggcatttgtcattttgccccctatgttcaatttttgtgggttgttagtttataaaaatatgcatagtttatcaagatgggactgtaatctccaagcttgggatgagcagcatatatattgtgatggttgatagcatatggcttatctcataattcatgacatcacaaactattgggtaaaggcattataataggttatagcaacaaatataaaattatgcttagctgtgcaaaattatctaattgatgactatttctaaatacacatcatgggcaaaaaggtgcgaaaagttagtggcagagtacataaatttgaaaagaattataagtagttccgtactcgacatataacaaaactaaaatattcacacatttcatctccgttactttatgcggtgtataacatgagtgtacaagctagacaaaaatgacaacaaaaatacaacttttttgttgtaaaagaaaaacaaacttatcccatgcagaaactttatgacgcaggcacaaataaagccaagaaggaaaaacatctaaagtgtagggatagaaaatttctgaactaaaagaatatgcatttttctacaaaacacaataaaagcctagtatacatatagatgtcttgttaaccgactttgtgtatatatactttttttttttgcacaactcaatacactttataggatgtctattgtttatactccaagtaactttgtaactgccttacattccaagcggctttttcttggctataaaagggacctcatgtcttgggaaatcacatcagttgagtttccattatcctttca

SEQ ID NO: 6093 - DNA, 1923 bp, Oryza sp.
  misc_feature (1)..(1923): RS5-547
atcgccttttcgatcttatggtcccataataattttacatagagttgtgtgctactcattcgtgtattcatacaaataggtccatcatgtgttcatcacattatatcaataacacttgaatttaacataacaatccatcactcataaaatcaatccatcctctataagcattcgaaggaaagacaagtataagtgttgagtgagttggagtgatgatggtccttgtcagattctatcatcgtagtggcataaatgtatgcaatacccaaagtttcaagtgagaaaagaacaaatctcacattttgagcagtggcatatccactgtgtgggttttgtcaaccgtaccactaatagtttttctataccaacactagttaaagactacgatcgaaatcctggtgataactatagctcctaatctaatggtcggttgctcgttactagtccaaagggatatttttttatcagttacgtcttattttcttacaatattactatttatcatttcacttcagaaggggaaaaaaactcgccttcaattttgaaattgtatcacagaaaatgagagtttttatttttccattgtctgttaagaccttgtaaccagctgaatatcatcttgctaggataccgatactcttcttattttttttatcgaaaccactctttgagacctgtgtggccatacacaagattacctagatggtgacaaccgatgtgcgatatttgtccgcacaattcattcacatatatacattctgacatagagtctgcatggattcacgaaaccaaatcaccttccaaaaccgctatgaagtccgttccctctgcttttcacgaaaaccatcttaaaaaccattgactagccgtgaaattcaattaacttttaccaaaactttaaaatctagttaaactcttttttcctagctcgaccaatttactgagcggttttgtgatctcaacccaacaaaaaaacctatttaagtttccgcgaaaaccaagtggtttcgtaataaaccatctgcgcacacgcacagaagcccacaaccttccccgcgcgcgagtaccagcctcgtcgccgggcaacccaaacgtgcccccgcgcgtgcgcgcgcggctccgtgctccgctctccagccacctatctattctagccccttacgttacggccttttacgttactacgtacagctaatctaccagctccgctttccatgaacaccgccaaaaagcccaaaacctcccttgctctttgcagctcatgctctttctttctttgcccgacgccaaattgccaatgcttcgattcacgccttccattccattccatcccagcctcctaacaaccagtagcacattgcttgcatgcctaccttcgaaaatcgcagagcacatgaatgcacctgcccaggaccacggccactgtccgtttcttcctcctcgagaaggagcaactgatcgaactgcgcacgcacgcagtagctagcatcgcatcgcccgtttctgttgcgagaaagaagcaagcaaagcaaagcgaagcgctgatcatgcgcggcacggcgcagcctgcggattcagtggcatcgtgcagccggtattgcagatgagacaagccgggagatggatgccgttggtggagtgcccggcggggagcggggcttgctagctgtgtggggggcttttcgtcgcgaggagtgcacgccaccgtgcaggtggtggacgggacggaatggctataaaatgggggcgccattgccaagaatcccaagaacaccagccaggaatcagaagccagaagcagcaacgctcgctctgattctttctttcctcctcgagctaggtgcgtagttgtcatatttgatcgatcggttttagttcttcttgtttaattttgattgcgcttgtagcagcaggaagtagttt

SEQ ID NO: 6094 - DNA, 1974 bp, Oryza sp.
  misc_feature (1)..(1974): RS6
gagcacctttatccctgctgtttgcatgaaattagcttgtcttgtagttccctccagcaaaaagaagtctgaaacaaaacaacatttcgaaaaaaaggcatccatgagttagcatttctacagttgtctatagaggggaaggctgcacgacaaagtttccaggcttggaaacaacctcttatgtaaaatttttcgtatgtatcagatgatttgtttgcgttacggcatctccacctaacatcaccttcatcatgcgcctatggtctttctcttgcctgttttatacgtaaaattggaaacgacagaaacttttgccatctttattaaaggaaggcaaatatgcaaatataggcatcaagatcacagttagtggattatcatctttgtaggttaacatgtcctaccccaggggagcttatactcaagtactccatgcattttcatgaaatgagaaaaaacgatttttaagagaaatgtactttcttgtatttatgccaaatggcaaggactgaaagggaaaaactaagaaagggaacgttacagtaaggctctgtggggactggggacttcagagaaacgtgaaccctgcttccttcctctgcatgaacataacaccagaggtttccagcctttcacacagttgttgatggcttcacacaattcatctctacctcctgactctttataaggacccccagcatcaccacaattgcacaagtacaggcattagatccacaagaacacttgggcaggcaagcacctctttgatctttaagccgttgttatgttctatttctgagcatatggtttctagttatattctttttcttcattcgtttcatatctttgaagtgttgatgcaaatgcggtgaacaactatcaactgtgtactctccaagtgaatgcgaataatcatttcctgtgagaattgtgggctagataaacgaatgaaatgctgttttatctatgtcatgtgtggaaatttagttaattttccggtctttttatgcattgagatgggtatgctgtttttttagttgggtcccatcatcttgagaattctttcaaatttccttttctttatcctatataaaggatagagaaggcgtatgcctaggtgcaccaaccctgaaagttttattctaattgcgggaatggtttgtaatttttgcttgttcaggttctttttcgtggcctttcttttttttccccttattttgcttagtctttcacagtccaatttttgggaagtagtatatcttagtttggtcctaaggcaccatgttgtactgcaggaaaaaaaagagtaattgtattctgttttttccttgattactatatccctgttttaattaattttgtgcctttgttgtttgatgttggaacttcaatgcccataattagtcatttgacttgttttgggttttgacgctatcttgagtgccataggaaactggtagaatttagtaataattttatatagactgaatgttgagcccaccacaaatggtttccttctgtacaagtatttaataactcaagcacaggaaacatcagatctctaatctaaaggttaacaatgggctcaagcaggagcagtagttcagctctatctgtatatttagaagggctggatctacctgtccaccagcttttaattttaccctggcagctggataacttcttgtctgttaatttcatttagtgctgtgttattttcttcttgttgttcaggatggatgcttttgaatttctggaatttcgtattttgttctatctctttatgaaatgacgttatggcacactttttctgcatattcttgatgaaaataattacctagtcatttttttagttgcaggtttgtctgggactttgagtacccatgcaattcatgatgccattggatacgaatgcttgtgcacaaccaatgagaagggctggtgagggtgctgggactgagaggttgatggaaa

SEQ ID NO: 6095 - DNA, 1993 bp, Oryza sp.
  misc_feature (1)..(1993): RS8
gaatgtagcctcatcttctgtactacggctgtactactgcatttgggttgtctaaattcaatgggagacaaggctacgtgtagcccatggacgttcctggagtagcatcttttgattcagaaataaaatagcactccattattcgtactgaaaagaagtagtggcaacattttctaattctgaagattcagtttgtttccacttaaatgaatgggtcattttatatagattattagtaaaagtactaaaagtaagttattcacaaaagtcaaattttgtgttttatgatttttcaaccagccaaagaacattgaacattctaaaatttatgcaaattttggtgaaagaatagaacattcttctgccggtccatgcaacttttccatggtaaaaaaaacccatatcgaacttatttcattatagtataccataataactctgtaaggctacaactgcatactatgcctttccatgtgagaagcataggactatacaggtggcatagtttagtacagtgcccttccaagtttcatgtgacaagagatagcaatcactactgcagttactgcacaacttctgatttgttgagtcatcattatgtgttaacccttcacagaattttaagctttgaaagaaataggtgcttgatgatcttctaagcattcatattttcttgacctactaaaattcatttgtctgtttttcccaaatcaagggattttatgcgtaaaaacttccccacaaaattcagttgaatggtgtgtagatcaagtaaagctgttgggcgttagctgagtgtgggatcttgctgacacattttattgtttagataatgaaaatcttttatatcctcggtctcaatcatcagacacactaccaaatttagctgacacacttgctttccaatttcatatgactaatgttttatctatgcaacattttctctacctgactaaaatgcatctgatagcaaacaattcgcttgttttaaggcgtcaagaaatcacaaaacaagaacaattaaagggccaaagaatggccaaaagcagacaaaaaatagcacaataattaatctcgtcagtttggcacctctaatcttgcaaaataccttcagtgaaggatctcttttcagtttagttctgacattgttatgccaaaaagctctaaggtacaattttttcttcctaacaaactcttacaaacgctgacgtggcatactaaaacctttaactcgtcttaaggcgtcaagcaatcccaaaaaaactgtcagaagattgcacttaattagtcatcagaaatcaaaatcttgcaaaaagcacaacgaacacatctcctttctgttgaggtgacactgaactttacgctctgaaaactgaaagcgcataacaaaatcgcctttttaatcatcacgaattgtcctaattcggcttgcgtgttaataatctcttaccagatttcaacacgaagggtaataatcttgtcgccatgtaccaaccctcgcaacattttgccgcgcttttgcgtgggcgatgcgccaacttcccacgctataaataggcagccagttgaaccgagtgatctcatcttcatctcgcagcagagttggagactttgagctctcaactgaaccccaatctgcgaggtagcattgttcttctcatcgcctcctagctagctagcaaattatttgatttctgtagttatagaggctttttagcgtcattcgtatcctgcttaatgctccaaagaagtcaaattcgtgagattttggggatttgctattcggataggggggataaaaatcataaaactatataaaagtctcgtgtttgagtcagagtagtagtagccaagaaaccaagaggtcaaacagcgaaatctcgcggtgtttcgagtaggattttgatcttgagataaccccgccctgattaattaatcggttaattggtgtcgtgtttgatctcaaaagcgcaggtgggagaaggaggaggag

SEQ ID NO: 6096 - DNA, 2175 bp, Oryza sp.
  misc_feature (1)..(2175): RT16-1620
gagagggtatcgcttgccttgatggacgcgcgcgtgggccgggggaaatgtggtttggttgactcgcgcctgtcttgggccgtgattgattcagcccagtctgccagtttgctgtcttgaattctcggaggcccatgtagagaaatccatctatccacgtggaaacgtgggccatggccattgagcgaaatcagattagaaaaagtataatttgactccctcaactatcgcccgagtatgattcatatcctcccactacaaaacagatacatcgacccctacaattatcaaaaccaatgcaaacaatgtccctcggtggttttggctgaagtgtcgcctacgtggcggttttggctgagtctttgtcctacgtggcgcgtggcattagaataaaaaaatatgggacccatatgtcattcataaaaaaatatattatgggacccacatgtcatccttcctctccttcccttcttcctcccgtctttctctctcccttatctctctcccagcctttctgatcgaagcggcggtggcggcggtcgggagcagctgcggtggtggtggggagcggcgacgatggcggtcgggagcggcggctgtggcgatggggacgaggtggttgggagcagcggcggtagcagtggggacaaggcggtgggaaggggcggacgtgggccagtgctcgggcttgacggcggtgcagagtagggcgacctcggtgagcctcagcatgtcgccgtggcggtcccggtcggtgacgatctccacatcgaggatgtctgtcgaccactcatggctcagcgccagttgcgcccactccgccaggtcgtcgtcctcgtcgacggggaccttcccggtgaccacctcgagcagcacgagcccgaggcagaacacgtcggcatgggaggacagccgcctcccgcacgtgaactctgagcacttggccgccgcgagacgatgaccgtggtgcagaagcagcgggtagaacccgtggtcggtcaacttggccaccggcaccacgtcgccgccgctgccgggcgccgggaagacgacgagcacgttcgacgacttgaggttgccgtgcggcggccggtggacgaggtcgcctggctctggacacgcgcgtgcaccaccaccggacgccgccgtcgctccctaccgtcgtccccaccgccaccgccgccgctccagagagagagataagggagagagagggggaggaagaagggaaagagagggaagatgacatgtgggtcccacaatactttttattgtgtgaatgacatatgggtcctacatatttttttttgtttttattctaatgcaacgtaagcgctacgtaggactaagactgggtcaatactgccgcgtaggcgccacgtcagccaaaaccgcttccaaaaccacacaggaatatattttgcaccgattttaatagttagaggagtcaatatacctggttttgtggttggaggttatgaatcatactcgaggcatagttgagggaggccgtgtttagttgcaaattttctcttcaaacttcaaacttttccatcacatcaaaactttcgtacacacacaaacttccaactttttcgtcacattgttccaatttcaaccaaacttccaattttgaactaaacagcagccggagtcaaagtactttttccaatcagatttgagccgatcatgatttgaactcttcaaaactactagtaattttcagttcgaattcatgaaagttcacatcatgctatacctacacctagcatgtataggactggactgtattggtactagtactacagagtatcatagccgtacgggtatcatagacaagacaatacagaaagtacagtgtcctggaaacgtcaatgatcaaatcgaccatcaatccctcctcacctttcggctttccatcaaccggaatcaaatcggatagcgaagcaaagccaacggaagcaaagtaaacagggcattgccgtttctggagctcccctactgaaccgcctcgaaagcctcctcatcaccattcctcttcctcccatggcgaactcctttactcctcctccacccccaccgcctcgcccatccacaccgacgccaaggcagcgcttgttcttgttgttgttgttgttgttggcttcgctttgctgctaagctagctggaggaag

SEQ ID NO: 6097 - DNA, 2168 bp, Oryza sp.
  misc_feature (1)..(2168): RT27-1617
caataggggtacagcaaaactatgtccaaacaaaatttggtcccttaccctcttttttacagttttatattaccttgaaccgtcacatgatttgcattcgtccggttgcagacatcagcaaagatcttgggcgatttggattggaaatggaacctacaggaaaaatagttgttgagagcttgagctttcaagccgttgggagcccataacccatgaaagacaagaaaattaatataagaatcaggtggtatatgctactgcctttgcatgtatattagcatacaaatttgttttagacagcagtattggaaaaatatagtgtgattatgtagtttgcccccaacaaaaagtgggacaatgatgatacagcatgaaaattttgcaccctcccccacacccaaaacattatggtgctttttcatgctcttccagagtgcactatgaaaaggatgtttgtaaaattcataaaaatatgaacttgtgtatcatgttcacacctaacttcaaaaacaaaagcacaacataaaaagaaatatttgatatgcgatactatttttgtaacatcatgatttaaaatcaatatatgaagatcttcccaggttgtcttaatcaaagaaggcagtaattggattctcagatgaaatgtgatattcaagggcaccatagttgatctgcgacaatggaatttcctaaagttggaaaggcaggaaacataataagattcaatcatgcagctcaattaagataataatccaatttcgtttcgaatctgaaccataggatctcaccagagccagacccaccctaatcaagagaacaatcaccaggcaggaatgactgtcttcttaagctttgtattgatttcagcagctgcagaaattaattccagaaagacctagattattctaggctgataaaaatgatctagtaagacaatcatggatctgttcagagctcaagaaaaatttgctattaaatatctaccttttcaaactgcccctatatggtggagccatggtcaaagaaaaataatatggattcaaggatatatctctaattgtgtcttctccatttgtttatgatcctcgagaaaatggtaggaggaaggcagacaaggtgatgagatggctgttttcttctcatgttgcgtgcatggatgtctttcagaggtaagaacaaggaacccacacttggtttagcacgtgggaaatatctgatgaaggtgatcgggtcgatgaaggtgatcgggtccacatcataggttcaaaacttggtgtggttgagcatccaatattccctacttcagcgctgttgttcaattggatgtcctgcaaatggcggctggtagtaagcagggcagatgtagttccacagaacaacctgcatgcaagtatgcaacatatatgccaggttattatattagctagtagtatataataagtttcttggttactactcgtctacttgttgaagttcttgccttgatcatggatacttcacatttccttctaacctctgctttgtcatttcatacctgatttcagtgtgggaacacagaataaacacattagtccaagcaaataagttttcaagccaaataatacaaaattacagctcaatcatgtggttaccttccataccatctttctgcctaagttaaaagtgtctaaccaggaatcaatacgaagacacaagtgttatgatagccctcttatcacccaaagcacccttcttaaaaaactatatctggcagaaccaagcacaacattacacatataaaacaactacgagcacaagacaaaggtagggaaaaaggattaggtgaagtttctgtcacatcacatgatagtcatactgtttgccccaatagacagcattcctaagtcagcataatcaaaggctcatatacatttaagtatggacacagccaacaagaatccttacccaggaccaaggacatgcaattgcatgcaccagaaacgagggcagattagtcttttctcatccaaaaaaaatgtatcgtggttctgttccttaatatggttcaaaacaccactatatataacccatgttctggtgaccagtgacctgagaaaaagctcagggaccaagtagaggcaactcatctgccctctcctactaggattgtcgtcctacttcttatccat
